United States Patent
Macleod et al.

(10) Patent No.: US 10,100,349 B2
(45) Date of Patent: Oct. 16, 2018

(54) METHODS OF DETERMINING POLYMORPHISMS

(71) Applicant: President and Fellows of Harvard College, Cambridge, MA (US)

(72) Inventors: Iain J. Macleod, Boston, MA (US); Christopher F. Rowley, Boston, MA (US); Max Essex, Sharon, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 110 days.

(21) Appl. No.: 15/026,031

(22) PCT Filed: Sep. 30, 2014

(86) PCT No.: PCT/US2014/058278
§ 371 (c)(1),
(2) Date: Mar. 30, 2016

(87) PCT Pub. No.: WO2015/048730
PCT Pub. Date: Apr. 2, 2015

(65) Prior Publication Data
US 2016/0244817 A1    Aug. 25, 2016

Related U.S. Application Data

(60) Provisional application No. 61/945,187, filed on Feb. 27, 2014, provisional application No. 61/884,352, filed on Sep. 30, 2013.

(51) Int. Cl.
*C12Q 1/68*   (2018.01)
*C12Q 1/6827*   (2018.01)
*C12Q 1/70*   (2006.01)

(52) U.S. Cl.
CPC ........... *C12Q 1/6827* (2013.01); *C12Q 1/703* (2013.01); *C12Q 2600/106* (2013.01); *C12Q 2600/156* (2013.01)

(58) Field of Classification Search
CPC .................................. C12Q 1/68; C07H 21/00
See application file for complete search history.

(56) References Cited

U.S. PATENT DOCUMENTS

| | | | | |
|---|---|---|---|---|
| 5,437,975 A | * | 8/1995 | McClelland | C12Q 1/6858 435/6.1 |
| 6,528,288 B2 | * | 3/2003 | Senapathy | C12Q 1/6853 435/6.1 |
| 2005/0118623 A1 | * | 6/2005 | Belousov | C12Q 1/6827 435/6.14 |
| 2005/0123980 A1 | | 6/2005 | Senapathy | |
| 2005/0196750 A1 | * | 9/2005 | Elagin | C12Q 1/6883 435/5 |
| 2006/0057561 A1 | | 3/2006 | Hart | |
| 2010/0173795 A1 | | 7/2010 | Kozal | |
| 2012/0244523 A1 | * | 9/2012 | St. John | C12Q 1/703 435/5 |

FOREIGN PATENT DOCUMENTS

EP           2322668 A2     5/2011
WO    WO 2006/031870    *  3/2006

OTHER PUBLICATIONS

Kant et al. Avian Pathology 26 :837 (1997).*
Abravaya et al. Nucleic Acids Research 23(4) :675 (Year: 1995).*
Girgis et al. Nucleic Acids Research 16(21) : 10371 (Year: 1988).*
Mack et al. PNAS 85 :6977 (Year: 1988).*
Nunberg et al., J. of Virology 63(8) : 3240 (Year: 1989).*
Rowley et al., J. of Virological Methods 149 :69 (Year: 2008).*
Saiki et al., Nature 324 :163 (Year: 1986).*
Agilent. Introduction to Quantitative PCR [online] 2012 (retrieved Apr. 13, 2015]. Available on 19-22 the internet: <http://www.google.com/url?sa=t&rct=j&q=&esrc=s&source=web&cd=5&ved=OCDwQFjAE&url=http%3A%2F%2Fwww.chem.agilent.com%2FLibrary%2Fbrochures%2FBrochure_Guide%2520to%2520QPCR_IN70200C.pdf&ei=Cv4pVc3_1M6gugSRuYDwBw&usg=AFQjCNEXAA7b7-IUJaCTcGE2ToxQPScjow&sig2=HIRxVSD8vFxIn5ttQdKBtO&bvm=bv.90491159,d.c2E>.
Buonaguro et al. Human immunodeficiency virus type 1 subtype distribution in the worldwide epidemic: pathogenetic and therapeutic implications. Oct. 2007 vol. 81 No. 19, pp. 10209-10219.
Burucoa et al.. Ouadruplex real-time PCR assay using allele-specific scorpion primers for detection of mutations conferring clarithromycin resistance to Helicobacter pylori. J Clin Microbial Jul. 2008 vol. 46 No. 7 pp. 2320-2326.

* cited by examiner

*Primary Examiner* — Ethan C Whisenant
(74) *Attorney, Agent, or Firm* — Banner & Witcoff, Ltd.

(57) ABSTRACT

Methods and compositions for determining the presence of a polymorphism at a target nucleotide position in a plurality of target nucleic acid sequences is provided.

47 Claims, 18 Drawing Sheets

Specification includes a Sequence Listing.

FIG. 3

① Probe Binding Site / 103

The fluorescent probe is a perfect match for ~63% of patient *pol* sequences. A single mismatch has the potential to completely abrogate probe binding.

Forward 100-102

Reverse 104-107

② 103

Primers that exactly match the probe sequence flank the 103 region and alter the amplicon to remove any polymorphisms not associated with drug resistance

③ 103

After a single round of PCR only one region will have been altered on separate PCR product DNA strands.

④ 103

After 10 rounds of PCR, there will be an excess of PCR amplicons that contain a nucleotide sequence flanking both sides of the 103 position that perfectly match the probe binding site

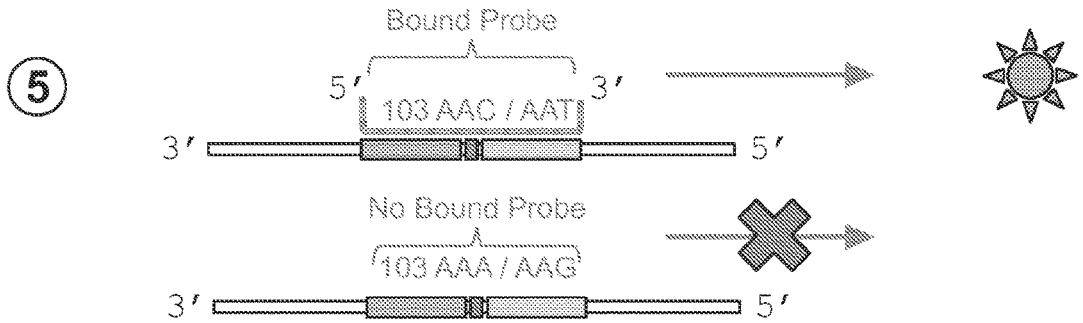

Upon binding to the perfectly matched sequence, the 5' flurophore on the probe is cleaved by the DNA polymerase enzyme and is irreversible released into the reaction whereby fluorescence is detected and quantified.

⑥

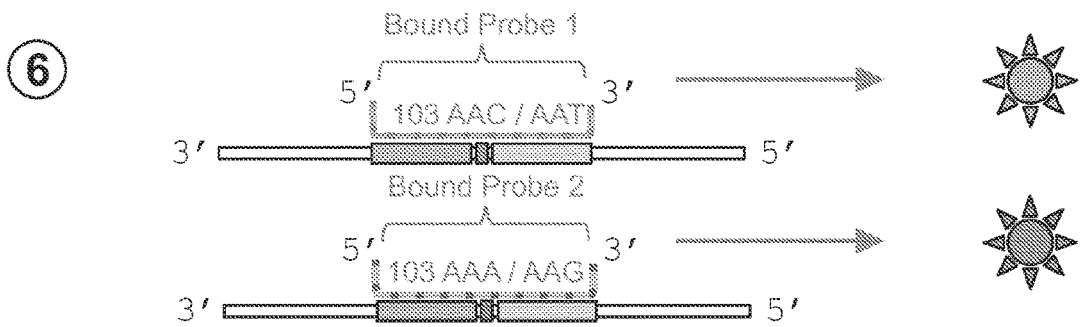

The same reaction can be multiplexed with probes specific for the wild-type and mutant targets that will be conjugated with a different fluorescent molecule. These probes will compete for the same template, and only the perfectly-matched probe will bind and emit fluorescence.

⑦

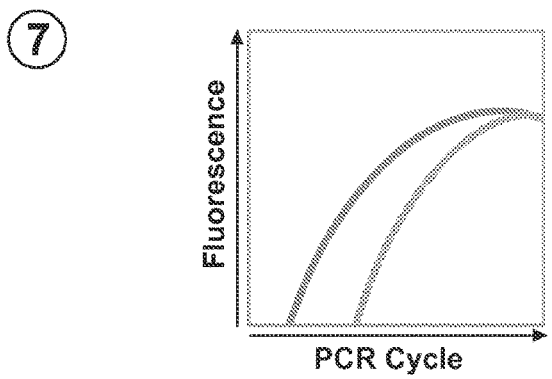

As the PCR product concentration doubles with each cycle, there is a corresponding exponential increase in fluorescence from the probes. The difference in probe fluorescence at any given cycle can be used to determine the relative abundance of the wild-type vs. mutant template.

① A primer with no 5' complementary GC sequence will form primer dimers that are extended by DNA polymerase in the qPCR and will act as templates in the next PCR cycles.

5'-TYTGGGAAGTTCAATTAGGAATACRCATCCMGCAGGKTAAAAAAG-3'
      ||||||
3'-GAAAAAATTKGGACGMCCTACRCCATAAGGATTAACTTGAAGGGTYT-5'

DNA polymerase will extend in 5'-3' direction
DNA polymerase will extend in 5'-3' direction ② A primer with a 5' complementary GC sequence will form primer dimers at the 5' that cannot be extended by DNA polymerase 8bp GC
5'-CGCGCGGCGTYTGGGAAGTTCAATTAGGAATACRCATCCMGCAGGKTAAAAAAG-3'
         ||||||
3'-GAAAAAATTKGGACGMCCTACRCCATAAGGATTAACTTGAAGGGTYTGCGCGCGC-5'
                                                   8bp GC DNA polymerase cannot extend in 3'-5' direction
DNA polymerase will extend in 5'-3' direction ③ A primer with a 5' complementary GC sequence may still form a primer dimer similar to (1) and will be extended by DNA polymerase 8bp GC
5'-CGCGCGGCGTYTGGGAAGTTCAATTAGGAATACRCATCCMGCAGGKTAAAAAAG-3'
         ||||||
3'-GAAAAAATTKGGACGMCCTACRCCATAAGGATTAACTTGAAGGGTYTGCGCGCGC-5'
                                                   8bp GC DNA polymerase will extend in 5'-3' direction
                                    Synthesized primer dimer product   8bp GC ④ The synthesized primer dimer product will contain a 3' region complementary to the 5' GC sequence 5'-CGCGCGGCGTYTGGGAAGMCCTACRCCATAAGGATGYGGTATTCCTAATTGAACTTCCCAPACGCCGCGCG-3'
         ||||||
3'-GAAAAAATTKGGACGMCCTACRCCATAAGGATTAACTTGAAGGGTYTGCGCGCGC-5'
                                                   8bp GC

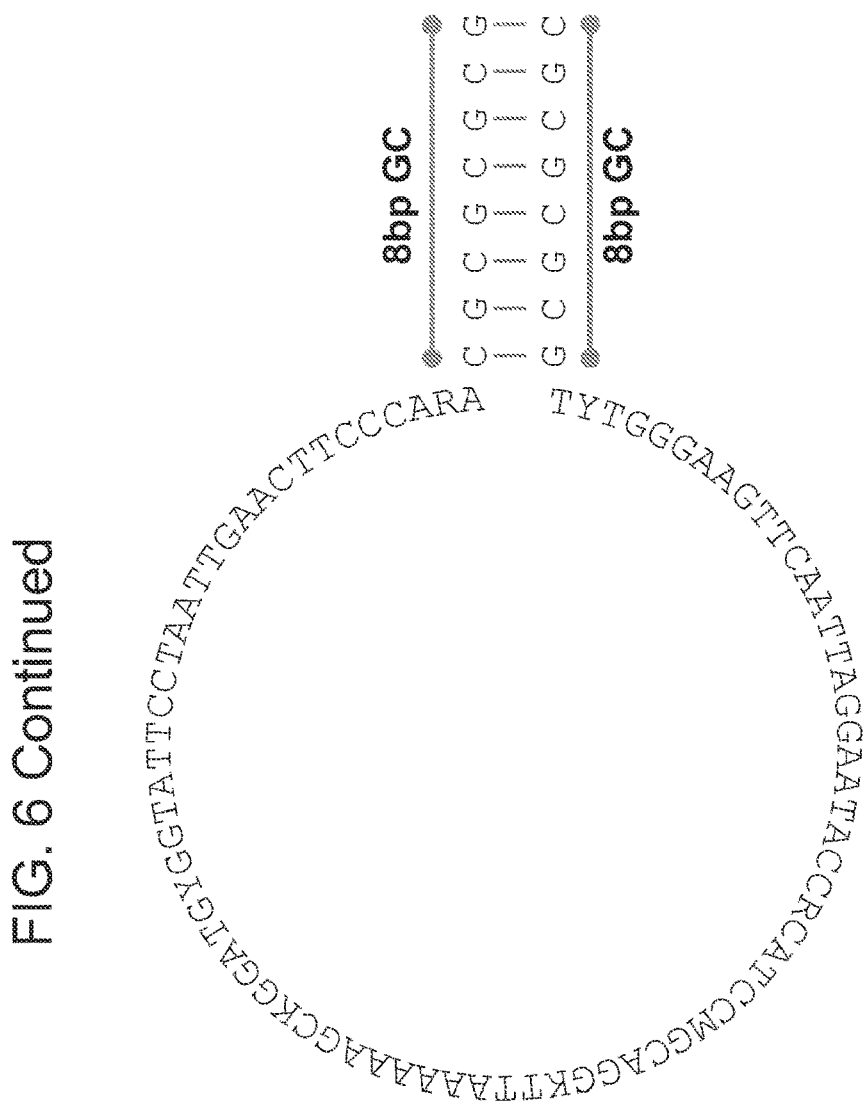

FIG. 9

| Forward Primer | 5' GGG ANG TYC ANY TAG GRA TAC CDC AYC CHG CRG GDY THA AAA AG 3' |
|---|---|
| Subtype A   | 5' ... .A. ... .T. .AT ... .A. ... .A. .T. .A. .G. .TT .A. ... 3' |
| Subtype AE  | 5' ... .A. ... .T. .AT ... .A. ... .G. .T. .A. .A. .TT .A. ... 3' |
| Subtype B   | 5' ... .A. ... .T. .AT ... .A. ... .A. .T. .C. .A. .GT .A. ... 3' |
| Subtype C   | 5' ... .G. ... .T. .AT ... .A. ... .G. .C. .A. .A. .GT .A. ... 3' |
| Subtype D   | 5' ... .A. ... .T. .AC ... .A. ... .A. .T. .T. .A. .GC .A. ... 3' |

| Reverse Primer | 3' AAA TCA GTR ACA GTR YTR GAT GTR GGD GAT GCA TAV TTV TCA GTV CCY–5' |
|---|---|
| Subtype A   | 3' ... ... .A. ... ..A C.A ... ..G ..G ... ..C ... ..T ... ..T ..T 5' |
| Subtype AE  | 3' ... ... .A. ... ..A C.A ... ..G ..A ... ... ... ..T ... ..T ..T 5' |
| Subtype B   | 3' ... ... .A. ... ..A C.G ... ..G ..T ... ... ... ..T ... ..T ..C 5' |
| Subtype C   | 3' ... ... .A. ... ..A T.A ... ..G ..G ... ... ... ..T ... ..T ..T 5' |
| Subtype D   | 3' ... ... .A. ... ..A C.G ... ..G ..T ... ... ... ..T ... ..T ..C 5' |

FIG. 11
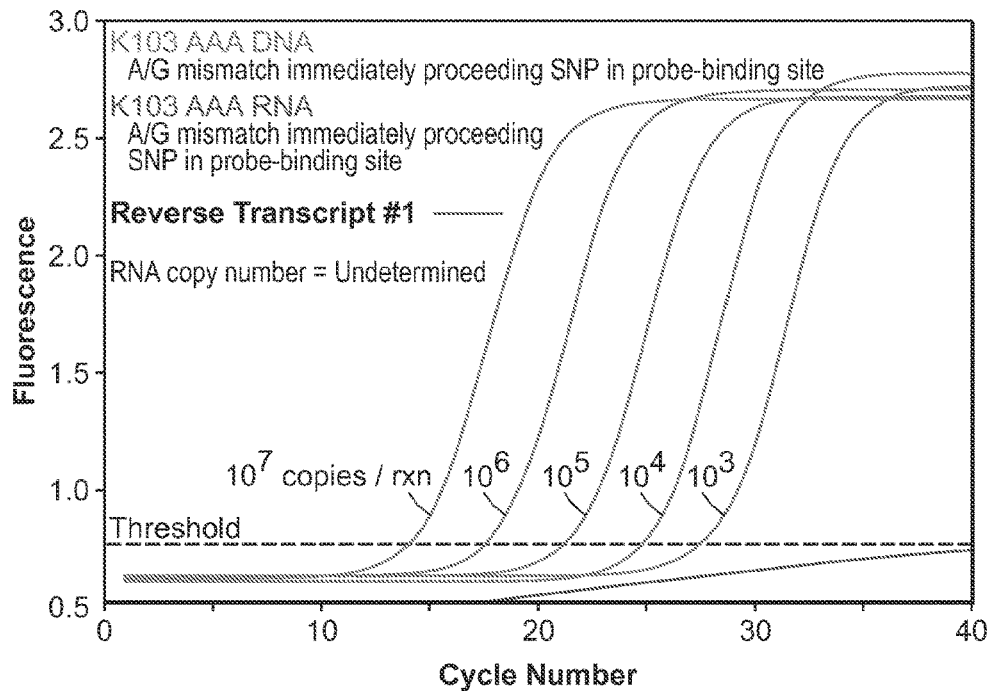
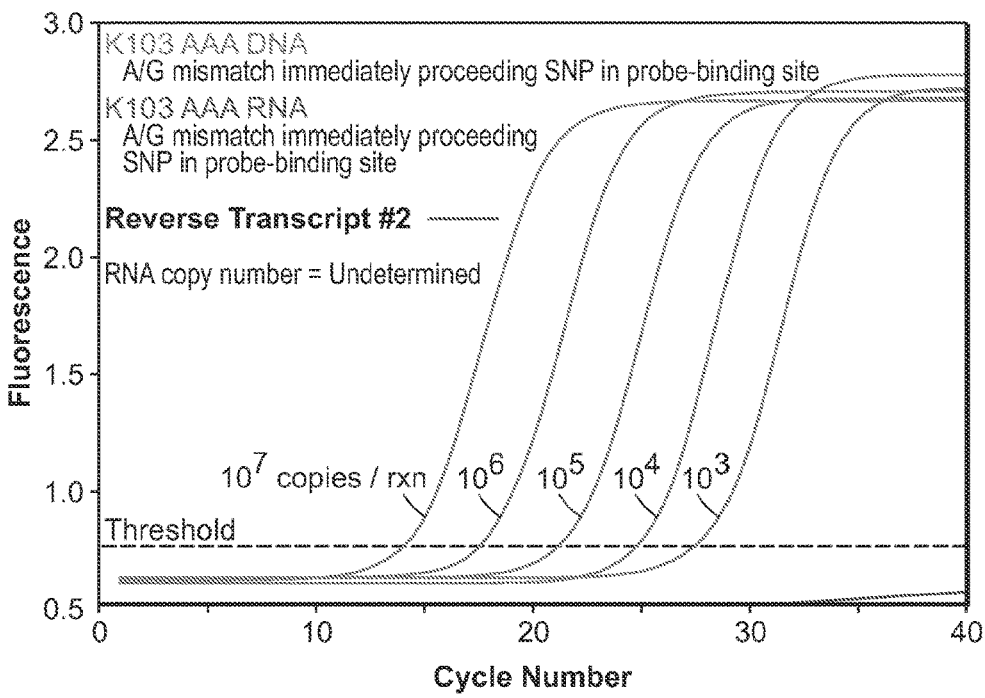

FIG. 11 Continued
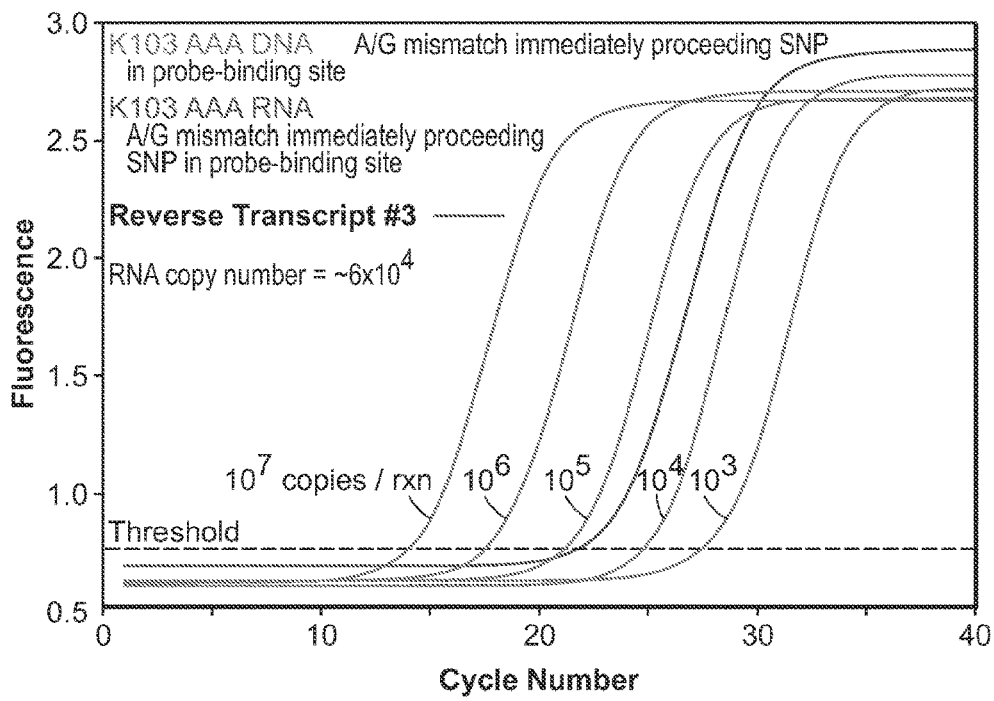
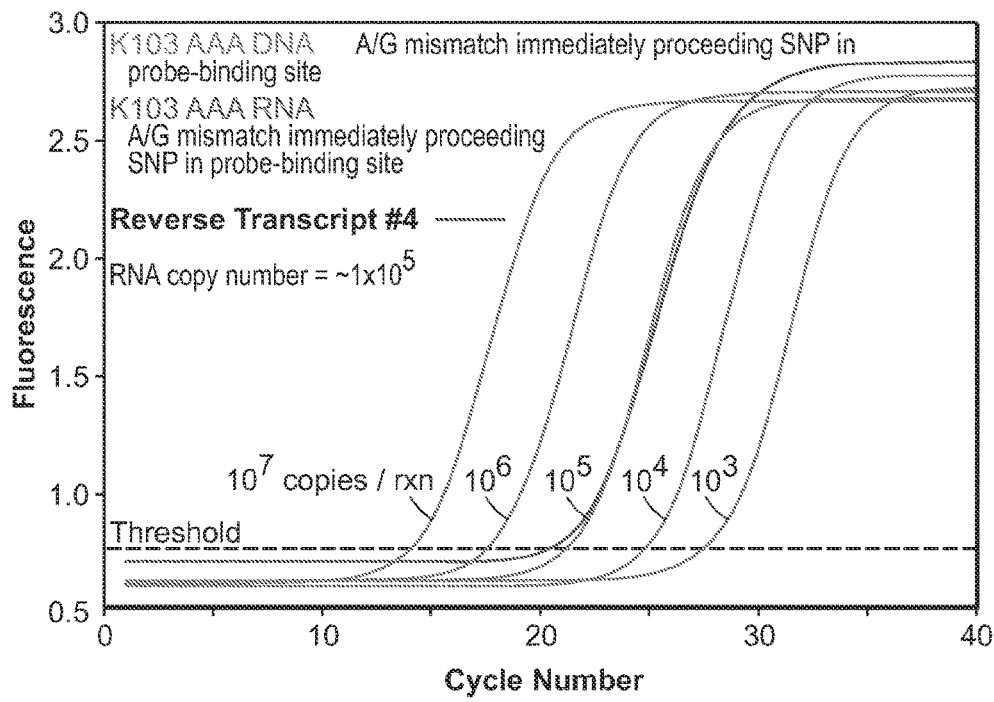

FIG. 11 Continued
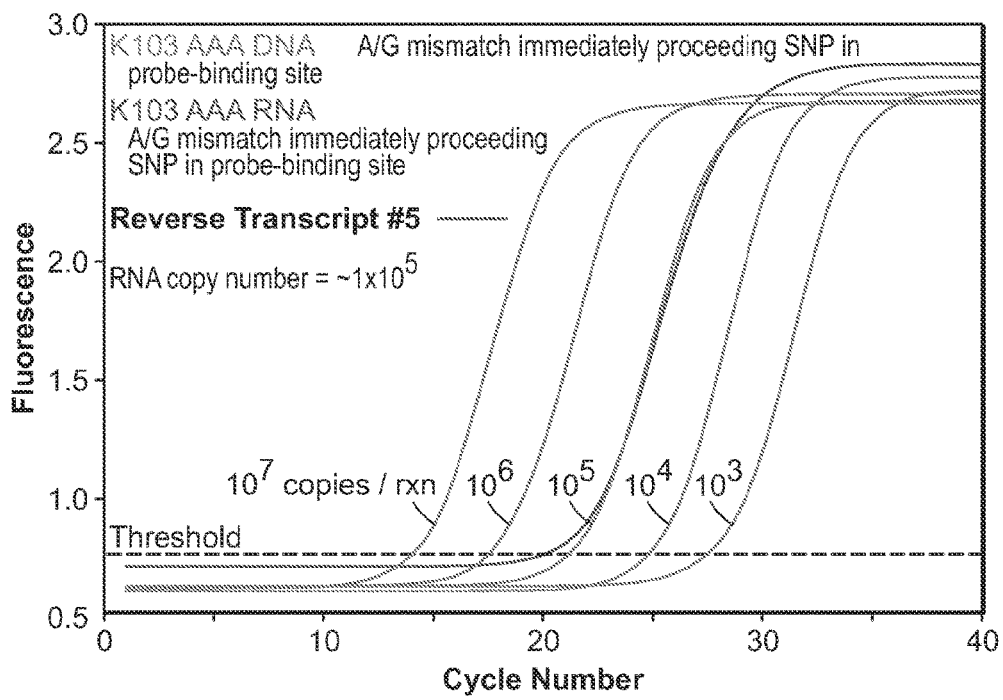
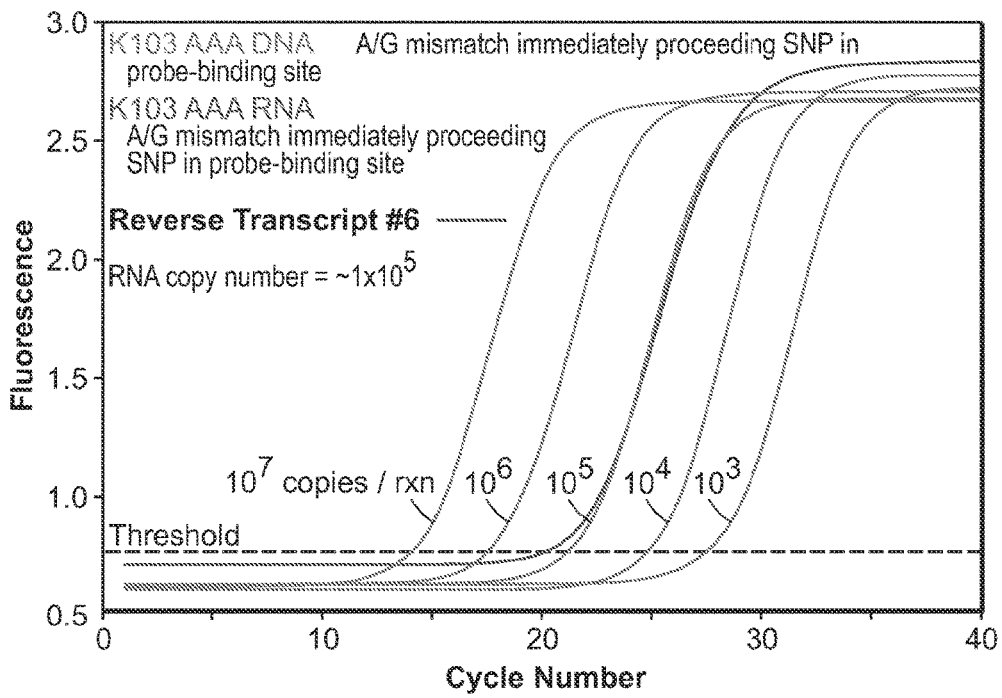

FIG. 14
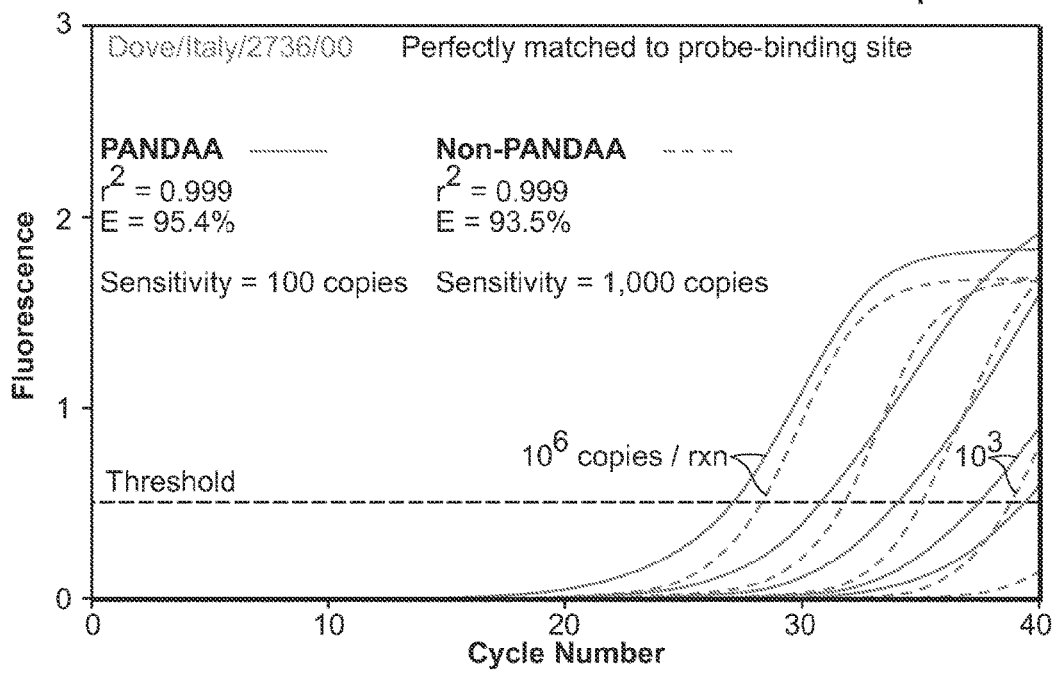
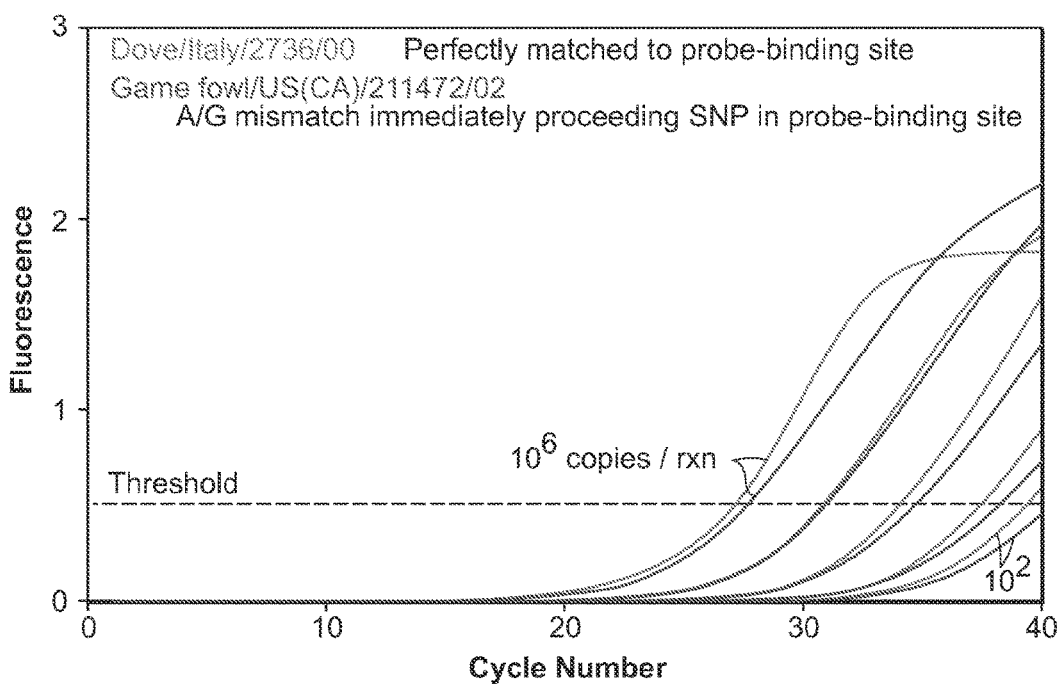

FIG. 14 Continued
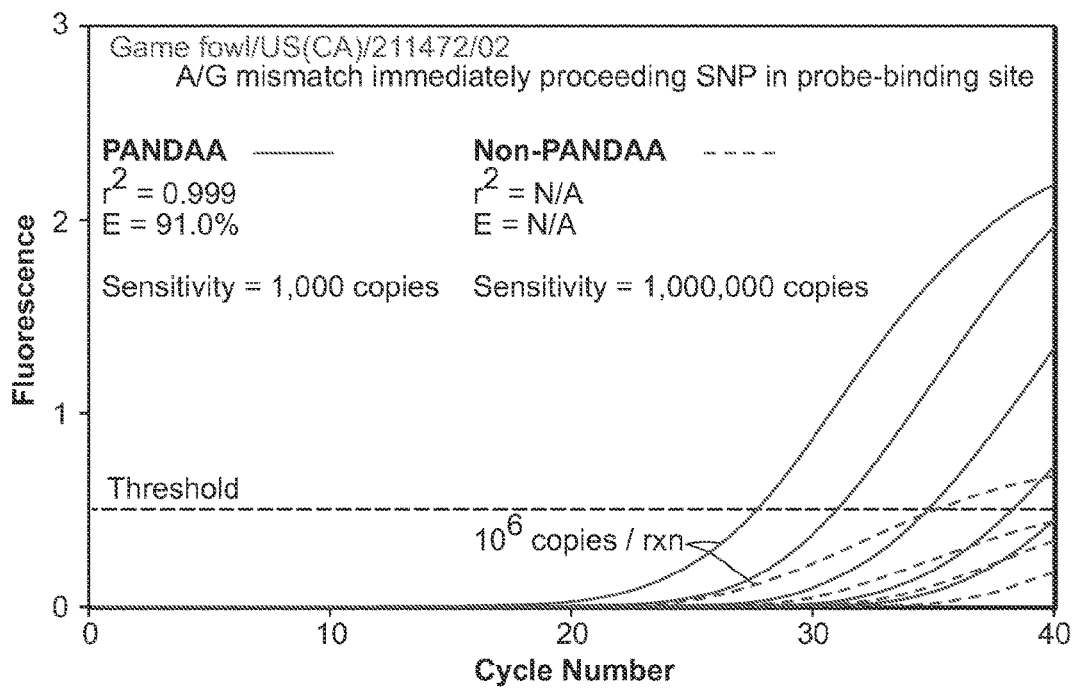
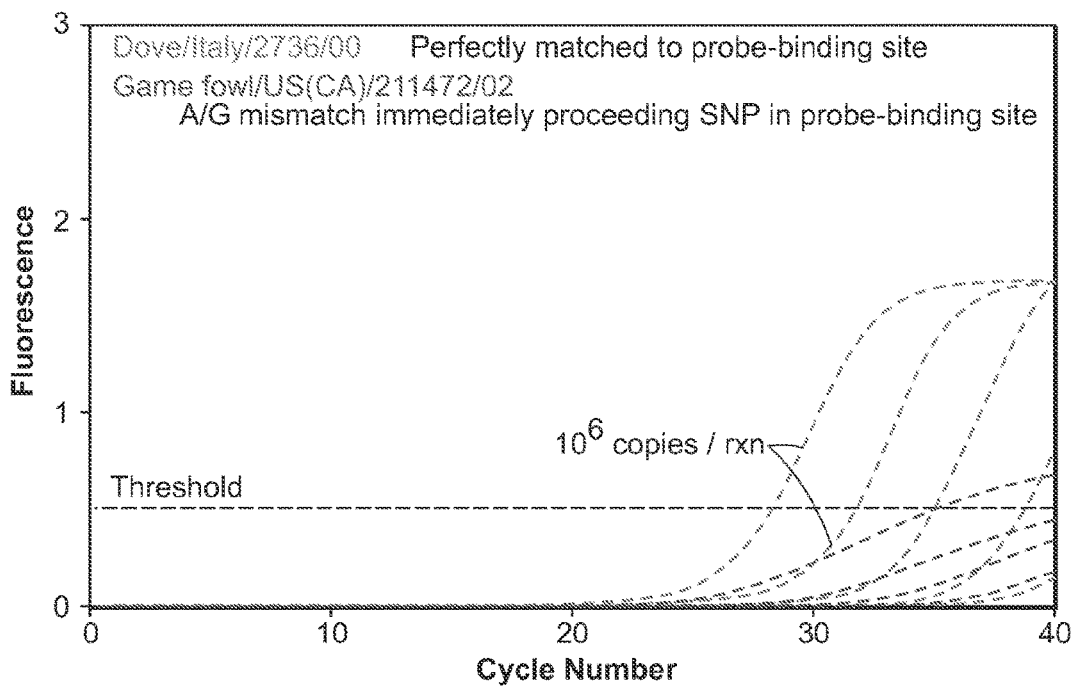

METHODS OF DETERMINING POLYMORPHISMS

RELATED APPLICATION DATA

This application is a National Stage Application under 35 U.S.C. 371 of co-pending PCT application number PCT/US14/58278 designating the United States and filed Sep. 30, 2014; which claims the benefit of U.S. provisional application No. 61/945,187 and filed Feb. 27, 2014 and U.S. provisional application No. 61/884,352 and filed Sep. 30, 2013 each of which are hereby incorporated by reference in their entireties.

REFERENCE TO SEQUENCE LISTING

This application includes as part of its subject matter a Sequence Listing electronically submitted via EFS-Web on Feb. 16, 2018, as a single text file named "Sequence_Listing_ST25.txt". The Sequence listing text file was created on Feb. 15, 2018 and is 10.9 Mb in size. The contents of the Sequence Listing are hereby incorporated by reference.

STATEMENT OF GOVERNMENT INTERESTS

This invention was made with government support under 1 R01 AI089350-03 awarded by the National Institutes of Health/National Institute of Allergy and Infectious Diseases. The government has certain rights in the invention.

BACKGROUND

Field of the Invention

Embodiments of the present disclosure relate in general to methods for determining the presence of a polymorphism at a target nucleotide position. Embodiments of the present disclosure also relate in general to methods of introducing known sequences flanking a target nucleotide position into amplicons of a target nucleic acid sequence. A probe complementary to the known sequences flanking the target nucleotide position can then be used to identify the presence of a polymorphism at the target nucleotide position.

Description of Related Art

Methods exist to identify polymorphisms in target nucleic acid sequences. See U.S. Pat. No. 7,368,242; U.S. Pat. No. 6,830,887; US 20030054339; U.S. Pat. No. 8,318,428; U.S. Pat. No. 7,115,364; U.S. Pat. No. 6,410,231; US 20120088246; US 20100009355; US 20130045881; WO1999016910; Billard et al., Appl. Environ. Microbiol. (2012); 78(4):1063-8; Hymas et al., J. Virol. Methods (2007); 142(1-2): 10-14; Rowley et al., AIDS Res. Hum. retroviruses (2010); 26(3):293-300; Rowley et al., J. Virol. methods (2008); 149(1): 69-75; Stevenson et al., J. Clin. Microbiol. (2005); 43(5):2391-98; and Whiley et al., J. Clin. Virol. (2006); 35(1): 81-83.

However, in certain replicating organisms, one or more secondary polymorphisms may be present near a primary polymorphism in a target nucleic acid sequence which may prevent or inhibit probe binding to the target probe binding site, thereby resulting in a false negative.

SUMMARY

Methods of the present disclosure take into consideration the possible presence of one or more secondary polymorphisms in a target nucleic acid sequence which may inhibit binding of a nucleic acid probe to a target probe binding site including a primary polymorphism. A primary polymorphism is a polymorphism of interest which is the target of being identified using the methods described herein. Accordingly, there is no particular limit to a particular polymorphism which is the subject of the methods described herein. Methods of the present disclosure produce amplicons having known 5' and 3' flanking regions to a target nucleotide position having a target nucleotide, such as a wild type nucleotide or a polymorphism or to a target nucleotide sequence including polymorphisms and one or more wild type nucleotides. In this manner, secondary polymorphisms on either the 5' or 3' side of the target nucleotide position or nucleotide positions in a sequence which may be present in the original target nucleic acid before amplification and which may inhibit probe binding are not present in amplicons which retain the target nucleotide or nucleotide positions in a sequence. Instead, known flanking regions are introduced into the amplicons. According to one aspect, the known flanking regions are based on the consensus or average sequence from known variants of the target genome. The probe binding site of the amplicons is therefore known or can readily be determined. In this manner, the original 5' and 3' flanking sequences in the original target nucleic acid may be referred to herein as being mutated to the determined consensus or average sequences of the 5' and 3' flanking sequences from known variants. Accordingly, the 5' and 3' flanking regions of the amplicons are known. Accordingly, the probe binding site of the amplicons is known or can be readily determined. A probe may be designed having a probe sequence which is complementary to the exact sequence of a known probe binding site which includes the target nucleotide, for example a known polymorphism, and the known 5' flanking region and the known 3' flanking region. Accordingly, one aspect of the present disclosure is directed to mutating the 5' and 3' flanking regions of a target nucleotide in a target nucleic acid to known 5' and 3' flanking regions, thereby reducing or eliminating probe binding inhibition which may result from the presence of secondary polymorphisms. In this manner, the probe is designed to be an exact match for the mutated probe binding region in the amplicons. Because the probe is an exact match for the mutated probe binding region in the amplicons, probe binding efficiency to the probe binding region is increased thereby reducing false negatives and improving identification of target nucleic acids having one or more primary polymorphisms.

Methods of the disclosure can be used to detect drug resistant or drug sensitive viruses such as, e.g., HIV-1, using genotyping. In certain aspects, methods for identifying drug resistant HIV-1 comprising identifying one or more mutations (e.g., substitutions, insertions and/or deletions) at specific amino acid positions of HIV-1 reverse transcriptase protein, HIV-1 integrase protein, and/or HIV-1 protease protein are provided. Kits for detecting mutations in HIV-1 reverse transcriptase protein, HIV-1 integrase protein, and/or HIV-1 protease protein using any of the method described herein are provided.

Further features and advantages of certain embodiments of the present invention will become more fully apparent in the following description of the embodiments and drawings thereof, and from the claims.

BRIEF DESCRIPTION OF THE DRAWINGS

FIG. 3 is a schematic of various method steps where primers are used to create amplicons having known 5' and 3' flanking regions to a target nucleotide position and a known probe sequence is used to identify the presence of a polymorphism.

FIG. 4 depicts that in putative primer-binding regions for the detection of SNPs at the 103 position of HIV-1 reverse transcriptase, variations in the primer-binding, and probe-binding, regions are shown as nucleotides A, C, T or G. Nucleotides that match the primer are given as dots. Positions within each HIV sequence that are identical to the primers/probe are shown as a dot.

FIG. 5 depicts that in putative primer-binding regions for the detection of SNPs at the fusion cleavage site of NDV, variations in the primer-binding region are shown as nucleotides A, C, T or G. Nucleotides that match the primer are given as dots. Positions within each NDV sequence that are identical to the primer are shown as a dot.

FIG. 6 depicts in schematic primer design that reduced dimer formation.

FIG. 7A is a graph showing primers designed using the majority consensus of HIV sequences.

FIG. 7B is a graph showing pan degenerate primers designed using the 95% consensus sequence.

FIG. 8A is a graph showing sensitivity of pan degenerate primers designed using the 95% consensus sequence.

FIG. 8B is a graph showing sensitivity of pan degenerate primers designed using the 95% consensus sequence in a multiplex qPCR using differentially labeled probes for the wild-type and drug resistance mutants.

FIG. 9 is a comparison of the pan degenerate primers for the detection of the K103 SNP with the corresponding primer binding regions in five of the most prevalent HIV subtypes. The adaptor regions (overlap with probe-binding regions) are shown in red, and the degenerate bases are highlighted in blue, where the mismatches are concentrated.

FIG. 10 is a graph showing that using a standard copy number of template per reaction, PANDAA methods described herein were able to detect the wild-type K103 codon with similar sensitivity across multiple HIV subtypes.

FIG. 11 are graphs showing SNP detection with various commercial reverse transcriptase enzymes.

FIG. 12 is a schematic showing that PCR product from a PANDAA reaction described herein, using primers with adaptor regions that introduced an intentional mismatch into the probe-binding region, was sequenced and that the alignment shows that the template was successfully altered to introduce an A to G mutation in the 104 codon, thus abrogating probe binding.

FIG. 13 is a schematic of an alignment of the PANDAA primers and probe with the genomes from two pathogenic NDV strains, with an additional alignment to the forward and reverse primers used by a USDA assay.

FIG. 14 are graphs showing a in the upper panels a comparison of the sensitivity and efficiency of PANDAA primers vs. USDA primers for the Dove/Italy/2736/00 and Game fowl/US(CA)/211472/02 NDV strains, respectively, and for the lower panels, a comparison per primer set for both NDV strains.

DETAILED DESCRIPTION

The present invention provides methods for the identification of one or more polymorphisms in a target nucleic acid of interest, such as a target nucleic acid from a virus, bacteria or fungus. A virus, bacteria or fungus can lead to detrimental health conditions in humans and animals, and the methods described herein can be used with a virus, bacteria or fungus associate with or otherwise infecting either a human or an animal. Polymorphisms can result in mutant strains having characteristics which differ from the wild type, such as drug resistance. It is advantageous for diagnosis or treatment of an individual or an animal to identify whether mutant strains including one or more polymorphisms of interest are present within an individual or an animal.

According to certain aspects, quickly replicating organisms such as viruses, bacteria and fungi introduce secondary polymorphisms near primary polymorphisms of interest. The secondary polymorphisms at or near a primary polymorphism of interest may reduce or inhibit probe binding at the probe binding site including the primary polymorphism of interest. Methods of the present disclosure are particularly advantageous in identifying the presence of one or more polymorphisms in a target nucleic acid in quickly replicating organisms which may have one or more secondary polymorphisms introduced into their genome. The methods disclosed herein introduce known 5' and 3' flanking regions to a target nucleotide position into amplicons of the original target nucleic acid. Since the 5' and 3' flanking regions of the original target nucleic acid are replaced with known 5' and 3' flanking regions in the amplicon, the detrimental effect of secondary polymorphisms in inhibiting probe binding to a probe binding site including the target nucleotide position is removed as the secondary polymorphisms which may be present are removed.

According to one aspect, a method is provided for determining the presence of a polymorphism at one or more of a target nucleotide position in a plurality of target nucleic acid sequences, with each target nucleic acid sequence having a sense strand sequence and an antisense strand sequence, wherein the one or more of a target nucleotide position is flanked by a 5' flanking region and a 3' flanking region in each of the sense strand sequence and the antisense strand sequence. According to one aspect, two or more or a plurality of polymorphisms may occur directly adjacent to each other or polymorphisms may be separated by one or more wild type nucleotides. Accordingly, one of skill in the art will readily understand that the methods described herein include detecting polymorphisms where two or more or a plurality of nucleotide positions have nucleotides that differ from the wild type. The 5' and 3' flanking regions flank the two or more or a plurality of polymorphisms. According to one exemplary aspect, the 5' and 3' flanking regions are immediately flanking a single nucleotide polymorphism. "Immediately flanking" refers to the flanking region being immediately adjacent to a single nucleotide polymorphism, i.e. the next nucleotide away from a single nucleotide polymorphism in either the 5' or 3' direction is a nucleotide in the 5' or 3' flanking region. According to an additional exemplary aspect, the polymorphism includes a series of nucleotide positions wherein two or more single nucleotide polymorphisms exist, i.e. a polymorphic sequence, and the 5' and 3' flanking regions are immediately flanking the polymorphic sequence. The polymorphic sequence can include between about 2 to about 5 nucleotides. According to one aspect, the end nucleotides in the polymorphic sequence are single nucleotide polymorphisms. According to one aspect, the polymorphic sequence can include one or more wild type nucleotides. According to one aspect, the end nucleotides in the polymorphic sequence are single nucleotide polymorphisms and the polymorphic sequence can include one or more wild type nucleotides.

Figure 1:
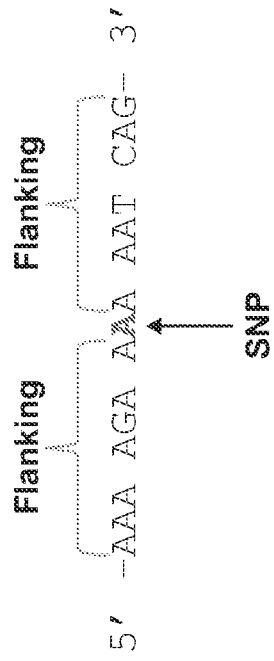
FIG. 1 is a schematic of a putative probe for the detection of the 103 SNP of HIV-1. The SNP is centered in the probe sequenced and is flanked by 7 nucleotides.
Figure 2:
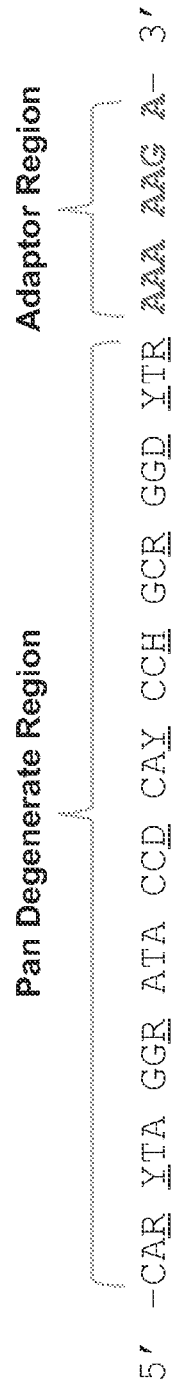
FIG. 2 is a schematic of a basic design of a primer for the pan degenerate amplification and adaptation assay described herein which includes a degenerate region that is complementary to multiple related polymorphic templates (i.e., a pan degenerate region), and an adaptor region that matches the probe-binding region.

The target nucleic acid sequences are amplified to produce amplicons using a forward primer and a reverse primer. The forward primer includes a 3' adaptor region. The 3' adaptor region is a determined consensus sequence for the 5' flanking region of the sense strand. The reverse primer includes a 3' adaptor region, wherein the 3' adaptor region is complementary to a determined consensus sequence for the 3' flanking region of the sense strand. One of skill in the art will readily understand how to determine a consensus sequence based on the present disclosure.

The amplicons resulting from amplification have an amplicon sense strand and an amplicon antisense strand. The amplicon sense strand includes a probe binding site including one or more of a target nucleotide at the one or more of a target nucleotide position with a 5' flanking region being the 3' adapter region sequence of the forward primer and with a 3' flanking region being the complement of the 3' adapter region sequence of the reverse primer. The amplicon antisense strand includes a probe binding site including one or more of a target nucleotide at the one or more of a target nucleotide position with a 5' flanking region being the 3' adapter region sequence of the reverse primer and with a 3' flanking region being the complement of the 3' adaptor region of the forward primer.

The method further includes contacting the amplicons with sense-oriented nucleic acid probes including a label or antisense-oriented nucleic acid probes including a label. According to one aspect, the probes have a probe sequence identical to the complement of the probe binding site. The probes hybridize to the probe binding site of the amplicons and the label of the bound probe can be detected.

Terms and symbols of nucleic acid chemistry, biochemistry, genetics, and molecular biology used herein follow those of standard treatises and texts in the field, e.g., Komberg and Baker, *DNA Replication*, Second Edition (W.H. Freeman, New York, 1992); Lehninger, *Biochemistry*, Second Edition (Worth Publishers, New York, 1975); Strachan and Read, *Human Molecular Genetics*, Second Edition (Wiley-Liss, New York, 1999); Eckstein, editor, *Oligonucleotides and Analogs: A Practical Approach* (Oxford University Press, New York, 1991); Gait, editor, *Oligonucleotide Synthesis: A Practical Approach* (IRL Press, Oxford, 1984); and the like.

Polymorphisms within the scope of the present disclosure include any desired polymorphism which can be identified using a nucleic acid probe. Polymorphisms, in general, refer to changes of a nucleotide at a single base-pair location on a nucleic acid. A polymorphism means a substitution, inversion, insertion, or deletion of one or more nucleotides at a genetic locus, or a translocation of DNA from one genetic locus to another genetic locus. In one aspect, polymorphism means one of multiple alternative nucleotide sequences that may be present at a genetic locus and that may comprise a nucleotide substitution, insertion, or deletion with respect to other sequences at the same locus. In one aspect, insertions or deletions at a genetic locus comprises the addition or the absence of from 1 to 10 nucleotides at such locus, in comparison with the same locus in another organism of a population. According to one aspect, the polymorphism is a substitution at a target nucleotide position.

Such polymorphisms can occur in organisms with highly variable genomes, such as pathogens in general. One of skill will readily understand and identify pathogens in general and those characterized with highly variable genomes. Such pathogens include such as viruses, bacteria, parasites and fungi. One of ordinary skill in the art will readily understand and appreciate that the methods described herein are not limited to any particular polymorphism, as the methods described herein are intended to determine the presence of a particular polymorphism known to those of skill in the art. Polymorphisms can readily be identified in literature in various organisms. Such organisms include pathogens in general which are well known to those of skill in the art. Target nucleic acids may include one or more primary polymorphisms. Primary polymorphisms are those which are of interest to be detected. Such primary polymorphisms may result in a change in the characteristics of the organism, such as a pathogen. However, a primary polymorphisms may not alter or change the phenotype of the organism, but may still be of interest to be detected. For organisms that quickly replicate, like viruses, bacteria, parasites and fungi, primary polymorphisms can result in drug resistance, virulent forms, and other detrimental characteristics. For organisms that quickly replicate, one or more secondary polymorphisms can also result in the genome. Secondary polymorphisms are those which are not of primary interest to be detected. One or more secondary polymorphisms are in proximity to the primary polymorphism to the extent that they are within sufficient distance to a primary polymorphism to inhibit a probe binding to a target probe binding site including the primary polymorphism. The one or more secondary polymorphisms may be in close proximity, for example within about 5 to about 10 nucleotides of the primary polymorphism. Secondary polymorphisms may not alter the characteristics or phenotype of the organism. However, secondary polymorphisms may alter the characteristics or phenotype of the organism. Secondary polymorphisms, however, can inhibit a nucleic acid probe if present in the probe binding site that includes the primary polymorphism. This is so because probes may be designed based on the known 5' and 3' flanking sequences to the target nucleotide position where a polymorphism can reside. If secondary polymorphisms are present in the 5' or 3' flanking region, the designed probe is not a perfect match for the probe binding site and the probe may fail to bind, thereby resulting in a false negative.

According to certain aspects, once an organism is selected, target nucleic acid sequences for the organism, for example a "genetic locus" or "locus", may be readily determined as being known in the literature or may be determined by sequencing methods known to those of skill in the art. Polymorphisms known to occur in the organism may also be readily determined as being known in the literature. Since the target nucleic acid sequence including a polymorphism for a particular organism is known, the 5' and 3' flanking sequences are also known or can be readily determined. A 5' flanking region is a nucleic acid sequence which lies 5' to a target nucleotide position. A 3' flanking region is a nucleic acid sequence which lies 3' to a target nucleotide position. According to one aspect, the 5' flanking region is immediately adjacent to the target nucleotide position. According to one aspect, the 3' flanking region is immediately adjacent to the target nucleotide position. From the sequence information of the target nucleotide at the target nucleotide position and the 5' and 3' flanking regions, a probe including a label can be designed as described herein. According to certain aspects, the methods are not limited to a single target nucleotide position. Rather, two or more or a plurality of nucleotide positions adjacent to one another can form a polymorphic sequence. A polymorphic sequence may be a series of nucleotides wherein two or more nucleotide positions within the series are single nucleotide polymorphisms. A polymorphic sequence may be a series of nucleotides wherein two or more nucleotide positions within the series are single nucleotide polymorphisms and wherein the polymorphic series can also include one or more wild type nucleotides. Accordingly, methods described herein may target more than one polymorphism where the polymorphic nucleotides are grouped together. For example, where there are three nucleotides of interest, i.e. three polymorphisms represented by "X", the three nucleotides, i.e. polymorphic sequence, would be grouped together and immediately flanked by the 5' and 3' flanking regions as follows: 5' flanking region ----->XXX<----- 3' flanking region. In another example, two nucleotides of interest may be separated by a nucleotide which has not changed from the wild type. The three nucleotides, i.e. polymorphic sequence, are immediately flanked by the 5' and 3' flanking regions as follows: 5' flanking region ----->X-X<----- 3' flanking region, where X represents the polymorphisms. In this example, two variable nucleotides, i.e. polymorphisms, are separated by a nucleotide that doesn't change.

"Genetic locus," or "locus" refers to a contiguous subregion or segment of a genome. As used herein, genetic locus, or locus, may refer to the position of a nucleotide, a gene, or a portion of a gene in a genome, including mitochondrial DNA, or it may refer to any contiguous portion of genomic sequence whether or not it is within, or associated with, a gene. In one aspect, a genetic locus refers to any portion of genomic sequence, including mitochondrial DNA, from a single nucleotide to a segment of few hundred nucleotides, e.g. 100-300, in length. Usually, a particular genetic locus may be identified by its nucleotide sequence, or the nucleotide sequence, or sequences, of one or both adjacent or flanking regions. In another aspect, a genetic locus refers to the expressed nucleic acid product of a gene, such as an RNA molecule or a cDNA copy thereof.

Target nucleic acid sequences include genomic nucleic acids of a particular organism. Such target nucleic acid sequences may be single stranded or double stranded and may include a sense strand and/or an antisense strand. Such target nucleic acid sequences may be a deoxyribonucleic acid ("DNA") or a ribonucleic acid ("RNA").

The target nucleic acid sequences may be amplified using methods known to those of skill in the art. Such methods include using a polymerase, primers and nucleotides. "Amplifying" includes the production of copies of a nucleic acid molecule via repeated rounds of primed enzymatic synthesis. Amplification can take place in solution or on a support. "In situ" amplification indicates that the amplification takes place with the template nucleic acid molecule positioned on a support or a bead, rather than in solution. In situ amplification methods are described in U.S. Pat. No. 6,432,360.

Amplification methods may comprise contacting a nucleic acid with one or more primers that specifically hybridize to the nucleic acid under conditions that facilitate hybridization and chain extension. Exemplary methods for amplifying nucleic acids include the polymerase chain reaction (PCR) (see, e.g., Mullis et al. (1986) Cold Spring Harb. Symp. Quant. Biol. 51 Pt 1:263 and Cleary et al. (2004) Nature Methods 1:241; and U.S. Pat. Nos. 4,683,195 and 4,683,202), anchor PCR, RACE PCR, ligation chain reaction (LCR) (see, e.g., Landegran et al. (1988) Science 241:1077-1080; and Nakazawa et al. (1994) Proc. Natl. Acad. Sci. U.S.A. 91:360-364), self sustained sequence replication (Guatelli et al. (1990) Proc. Natl. Acad. Sci. U.S.A. 87:1874), transcriptional amplification system (Kwoh et al. (1989) Proc. Natl. Acad. Sci. U.S.A. 86:1173), Q-Beta Replicase (Lizardi et al. (1988) BioTechnology 6:1197), recursive PCR (Jaffe et al. (2000) J. Biol. Chem. 275:2619; and Williams et al. (2002) J. Biol. Chem. 277:7790), the amplification methods described in U.S. Pat. Nos. 6,391,544, 6,365,375, 6,294,323, 6,261,797, 6,124,090 and 5,612,199, or any other nucleic acid amplification method using techniques well known to those of skill in the art. In exemplary embodiments, the methods disclosed herein utilize PCR amplification.

In certain exemplary embodiments, methods for amplifying nucleic acid sequences are provided. Exemplary methods for amplifying nucleic acids include the polymerase chain reaction (PCR) (see, e.g., Mullis et al. (1986) Cold Spring Harb. Symp. Quant. Biol. 51 Pt 1:263 and Cleary et al. (2004) Nature Methods 1:241; and U.S. Pat. Nos. 4,683, 195 and 4,683,202), anchor PCR, RACE PCR, ligation chain reaction (LCR) (see, e.g., Landegran et al. (1988) Science 241:1077-1080; and Nakazawa et al. (1994) Proc. Natl. Acad. Sci. U.S.A. 91:360-364), self-sustained sequence replication (Guatelli et al. (1990) Proc. Natl. Acad. Sci. U.S.A. 87:1874), transcriptional amplification system (Kwoh et al. (1989) Proc. Natl. Acad. Sci. U.S.A. 86:1173), Q-Beta Replicase (Lizardi et al. (1988) BioTechnology 6:1197), recursive PCR (Jaffe et al. (2000) J. Biol. Chem. 275:2619; and Williams et al. (2002) J. Biol. Chem. 277: 7790), the amplification methods described in U.S. Pat. Nos. 6,391,544, 6,365,375, 6,294,323, 6,261,797, 6,124,090 and 5,612,199, isothermal amplification (e.g., rolling circle amplification (RCA), hyperbranched rolling circle amplification (HRCA), strand displacement amplification (SDA), helicase-dependent amplification (HDA), PWGA) or any other nucleic acid amplification method using techniques well known to those of skill in the art.

"Polymerase chain reaction," or "PCR," refers to a reaction for the in vitro amplification of specific DNA sequences by the simultaneous primer extension of complementary strands of DNA. In other words, PCR is a reaction for making multiple copies or replicates of a target nucleic acid flanked by primer binding sites, such reaction comprising one or more repetitions of the following steps: (i) denaturing the target nucleic acid, (ii) annealing primers to the primer binding sites, and (iii) extending the primers by a nucleic acid polymerase in the presence of nucleoside triphosphates. Usually, the reaction is cycled through different temperatures optimized for each step in a thermal cycler instrument. Particular temperatures, durations at each step, and rates of change between steps depend on many factors well-known to those of ordinary skill in the art, e.g., exemplified by the references: McPherson et al., editors, *PCR: A Practical Approach* and *PCR2: A Practical Approach* (IRL Press, Oxford, 1991 and 1995, respectively). For example, in a conventional PCR using Taq DNA polymerase, a double stranded target nucleic acid may be denatured at a temperature greater than 90° C., primers annealed at a temperature in the range 50-75° C., and primers extended at a temperature in the range 72-78° C.

The term "PCR" encompasses derivative forms of the reaction, including but not limited to, RT-PCR, real-time PCR, nested PCR, quantitative PCR, multiplexed PCR, assembly PCR and the like. Reaction volumes range from a few hundred nanoliters, e.g., 200 nL, to a few hundred microliters, e.g., 200 microliters. "Reverse transcription PCR," or "RT-PCR," means a PCR that is preceded by a reverse transcription reaction that converts a target RNA to a complementary single stranded DNA, which is then amplified, e.g., Tecott et al., U.S. Pat. No. 5,168,038. "Real-time PCR" means a PCR for which the amount of reaction product, i.e., amplicon, is monitored as the reaction proceeds. There are many forms of real-time PCR that differ mainly in the detection chemistries used for monitoring the reaction product, e.g., Gelfand et al., U.S. Pat. No. 5,210,015 ("Taqman"); Wittwer et al., U.S. Pat. Nos. 6,174,670 and 6,569,627 (intercalating dyes); Tyagi et al., U.S. Pat. No. 5,925,517 (molecular beacons). Detection chemistries for real-time PCR are reviewed in Mackay et al., *Nucleic Acids Research*, 30:1292-1305 (2002). "Nested PCR" means a two-stage PCR wherein the amplicon of a first PCR becomes the sample for a second PCR using a new set of primers, at least one of which binds to an interior location of the first amplicon. As used herein, "initial primers" in reference to a nested amplification reaction mean the primers used to generate a first amplicon, and "secondary primers" mean the one or more primers used to generate a second, or nested, amplicon. "Multiplexed PCR" means a PCR wherein multiple target sequences (or a single target sequence and one or more reference sequences) are simultaneously carried out in the same reaction mixture, e.g. Bernard et al. (1999) *Anal. Biochem.*, 273:221-228 (two-color real-time PCR). Usually, distinct sets of primers are employed for each sequence being amplified. "Quantitative PCR" means a PCR designed to measure the abundance of one or more specific target sequences in a sample or specimen. Techniques for quantitative PCR are well-known to those of ordinary skill in the art, as exemplified in the following references: Freeman et al., *Biotechniques*, 26:112-126 (1999); Becker-Andre et al., *Nucleic Acids Research*, 17:9437-9447 (1989); Zimmerman et al., *Biotechniques*, 21:268-279 (1996); Diviacco et al., *Gene*, 122:3013-3020 (1992); Becker-Andre et al., *Nucleic Acids Research*, 17:9437-9446 (1989); and the like.

"Oligonucleotide" or "polynucleotide," which are used synonymously, means a linear polymer of natural or modified nucleosidic monomers linked by phosphodiester bonds or analogs thereof. Accordingly the oligonucleotide or polynucleotide may be considered a polymer of natural or modified nucleotides. The term "oligonucleotide" usually refers to a shorter polymer, e.g., comprising from about 3 to about 100 monomers, and the term "polynucleotide" usually refers to longer polymers, e.g., comprising from about 100 monomers to many thousands of monomers, e.g., 10,000 monomers, or more. Oligonucleotides comprising probes or primers usually have lengths in the range of from 12 to 60 nucleotides, and more usually, from 18 to 40 nucleotides. Oligonucleotides and polynucleotides may be natural or synthetic. Oligonucleotides and polynucleotides include deoxyribonucleosides, ribonucleosides, and non-natural analogs thereof, such as anomeric forms thereof, peptide nucleic acids (PNAs), and the like, provided that they are capable of specifically binding to a target genome by way of a regular pattern of monomer-to-monomer interactions, such as Watson-Crick type of base pairing, base stacking, Hoogsteen or reverse Hoogsteen types of base pairing, or the like.

"Primer" includes an oligonucleotide, either natural or synthetic, that is capable, upon forming a duplex with a polynucleotide template, of acting as a point of initiation of nucleic acid synthesis and being extended from its 3' end along the template so that an extended duplex is formed. The sequence of nucleotides added during the extension process is determined by the sequence of the template polynucleotide. Usually primers are extended by a DNA polymerase. Primers usually have a length in the range of between 3 to 36 nucleotides, also 5 to 24 nucleotides, also from 14 to 36 nucleotides. Primers within the scope of the invention include orthogonal primers, amplification primers, constructions primers and the like. Pairs of primers can flank a sequence of interest or a set of sequences of interest. Primers and probes can be degenerate in sequence. Primers within the scope of the present invention bind adjacent to a target sequence (e.g., an oligonucleotide sequence of an oligonucleotide set or a nucleic acid sequence of interest).

Primers suitable for use in the methods disclosed herein may be designed with the aid of a computer program, such as, for example, DNAWorks, Gene2Oligo, or using the parameters software described herein. Typically, primers are from about 5 to about 500, about 10 to about 100, about 10 to about 50, or about 10 to about 30 nucleotides in length. In certain exemplary embodiments, a set of primers is designed so as to have substantially similar melting temperatures to facilitate manipulation of a complex reaction mixture. The melting temperature may be influenced, for example, by primer length and nucleotide composition.

"Specific" or "specificity" in reference to the binding of one molecule to another molecule, such as a target sequence to a probe, means the recognition, contact, and formation of a stable complex between the two molecules, together with substantially less recognition, contact, or complex formation of that molecule with other molecules.

"Complementary" or "substantially complementary" refers to the hybridization or base pairing or the formation of a duplex between nucleotides or nucleic acids, such as, for instance, between the two strands of a double stranded DNA molecule or between an oligonucleotide primer and a primer binding site on a single stranded nucleic acid or between an oligonucleotide probe and a probe binding site on a single stranded nucleic acid. Complementary nucleotides are, generally, A and T (or A and U), or C and G. Two single-stranded RNA or DNA molecules are said to be substantially complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. According to certain aspects, probes described herein have 100% complementarity with their corresponding probe binding site. Alternatively, substantial complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See Kanehisa (1984) *Nucl. Acids Res.* 12:203.

"Duplex" refers to at least two oligonucleotides and/or polynucleotides that are fully or partially complementary undergo Watson-Crick type base pairing among all or most of their nucleotides so that a stable complex is formed of a sense strand and an antisense strand. The sense strand may be identified as the strand in the 5' to 3' direction in the hybridized duplex while the antisense strand may be identified as the strand in the 3' to 5' direction in the hybridized duplex. The terms "annealing" and "hybridization" are used interchangeably to mean the formation of a stable duplex. In one aspect, stable duplex means that a duplex structure is not destroyed by a stringent wash, e.g., conditions including temperature of about 5° C. less that the $T_m$ of a strand of the duplex and low monovalent salt concentration, e.g., less than 0.2 M, or less than 0.1 M. "Perfectly matched" or "100% complementarity" in reference to a duplex means that the polynucleotide or oligonucleotide strands making up the duplex form a double stranded structure with one another such that every nucleotide in each strand undergoes Watson- Crick base pairing with a nucleotide in the other strand, i.e. every nucleotide in a shorter strand undergoes Watson-Crick base pairing with a nucleotide in the other longer strand. The term "duplex" comprehends the pairing of nucleoside analogs, such as deoxyinosine, nucleosides with 2-aminopurine bases, PNAs, and the like, that may be employed. A "mismatch" in a duplex between two oligonucleotides or polynucleotides means that a pair of nucleotides in the duplex fails to undergo Watson-Crick bonding.

"Hybridization" refers to the process in which two single-stranded polynucleotides bind non-covalently to form a stable double-stranded polynucleotide. The term "hybridization" may also refer to triple-stranded hybridization. The resulting (usually) double-stranded polynucleotide is a "hybrid" or "duplex." "Hybridization conditions" will typically include salt concentrations of less than about 1 M, more usually less than about 500 mM and even more usually less than about 200 mM. Hybridization temperatures can be as low as 5° C., but are typically greater than 22° C., more typically greater than about 30° C., and often in excess of about 37° C. Hybridizations are usually performed under stringent conditions, i.e., conditions under which a probe will hybridize to its target subsequence. Stringent conditions are sequence-dependent and are different in different circumstances. Longer fragments may require higher hybridization temperatures for specific hybridization. As other factors may affect the stringency of hybridization, including base composition and length of the complementary strands, presence of organic solvents and extent of base mismatching, the combination of parameters is more important than the absolute measure of any one alone. Generally, stringent conditions are selected to be about 5° C. lower than the $T_m$ for the specific sequence at a defined ionic strength and pH. Exemplary stringent conditions include salt concentration of at least 0.01 M to no more than 1 M Na ion concentration (or other salts) at a pH 7.0 to 8.3 and a temperature of at least 25° C. For example, conditions of 5×SSPE (750 mM NaCl, 50 mM Na phosphate, 5 mM EDTA, pH 7.4) and a temperature of 25-30° C. are suitable for allele-specific probe hybridizations. For stringent conditions, see for example, Sambrook, Fritsche and Maniatis, *Molecular Cloning A Laboratory Manual,* 2nd Ed. Cold Spring Harbor Press (1989) and Anderson *Nucleic Acid Hybridization,* 1$^{st}$ Ed., BIOS Scientific Publishers Limited (1999). "Hybridizing specifically to" or "specifically hybridizing to" or like expressions refer to the binding, duplexing, or hybridizing of a molecule substantially to or only to a particular nucleotide sequence or sequences under stringent conditions when that sequence is present in a complex mixture (e.g., total cellular) DNA or RNA.

"$T_m$" is used in reference to "melting temperature." Melting temperature is the temperature at which a population of double-stranded nucleic acid molecules becomes half dissociated into single strands. Several equations for calculating the $T_m$ of nucleic acids are well known in the art. As indicated by standard references, a simple estimate of the $T_m$ value may be calculated by the equation. $T_m=81.5+0.41$ (% G+C), when a nucleic acid is in aqueous solution at 1 M NaCl (see e.g., Anderson and Young, "Quantitative Filter Hybridization," in *Nucleic Acid Hybridization* (1985). Other references (e.g., Allawi, H. T. & Santa Lucia, J., Jr., *Biochemistry* 36, 10581-94 (1997)) include alternative methods of computation which take structural and environmental, as well as sequence characteristics into account for the calculation of $T_m$.

Probes according to the present disclosure include nucleic acid sequences having a detectable label attached thereto. A probe according to the present disclosure may be referred to as a hybridization probe which is a fragment of DNA or RNA of variable length which is used in DNA or RNA samples to detect the presence of nucleotide sequences (the DNA target) that are complementary to the sequence in the probe. The probe thereby hybridizes to single-stranded nucleic acid (DNA or RNA) whose base sequence allows probe-target base pairing due to complementarity between the probe and target. According to certain aspects, the labeled probe is first denatured (by heating or under alkaline conditions such as exposure to sodium hydroxide) into single stranded DNA (ssDNA) and then hybridized to the target ssDNA (Southern blotting) or RNA (Northern blotting) immobilized on a membrane or in situ.

To detect hybridization of the probe to its target sequence, the probe is tagged (or "labeled") with a molecular marker or label, for example a fluorescent marker or other detectable moiety such as a radioactive moiety. DNA sequences or RNA transcripts that have moderate to high sequence similarity to the probe are then detected by visualizing the hybridized probe via autoradiography or other imaging techniques. Normally, either X-ray pictures are taken of the filter, or the filter is placed under UV light. Detection of sequences with moderate or high similarity depends on how stringent the hybridization conditions were applied—high stringency, such as high hybridization temperature and low salt in hybridization buffers, permits only hybridization between nucleic acid sequences that are highly similar, whereas low stringency, such as lower temperature and high salt, allows hybridization when the sequences are less similar.

Depending on the method, the probe may be synthesized using the phosphoramidite method, or it can be generated and labeled by PCR amplification or cloning. Methods of making nucleic acid probes are known to those of skill in the art. Exemplary probes include Scorpion® probes, Molecular Beacon probes, TaqMan® probes, LNA® (Locked Nucleic Acid) probes and Cycling Probe Technology (CPT). Molecular beacons according to the present disclosure include those known to exist to those of skill in the art and in the literature. Molecular beacons are hairpin-shaped nucleic acid probes functionalized with a label, such as a fluorophore, and a quencher on opposing ends. See Tyagi S, Kramer F R., Molecular beacons: probes that fluoresce upon hybridization, *Nature Biotechnology,* 14:303-8 (1996) hereby incorporated by reference in its entirety. The loop region of the probe is complimentary to a nucleic acid sequence of interest. In the absence of the target sequence, the probe retains its stem-loop structure and fluorescence is quenched. When the target sequence is bound by the loop region, the stem unfolds, affording fluorescence. Molecular beacons have been used in many capacities, including single nucleotide polymorphism (SNP) detection, real-time PCR applications, and many live cell imaging applications. See Manganelli R, Tyagi S, Smith I., Real Time PCR Using Molecular Beacons: A New Tool to Identify Point Mutations and to Analyze Gene Expression in *Mycobacterium tuberculosis, Methods in Molecular Medicine.* 54:295-310 (2001), Mhlanga M M, Vargas D Y, Fung C W, Kramer F R, Tyagi S., tRNA-linked molecular beacons for imaging mRNAs in the cytoplasm of living cells, *Nucleic Acids Research,* 33:1902-12 (2005), Rhee W J, Bao G., Simultaneous detection of mRNA and protein stem cell markers in live cells, *BMC Biotechnology,* 9:30 (2009), Santangelo P J, Nix B, Tsourkas A, Bao G., Dual FRET molecular beacons for mRNA detection in living cells, Nucleic Acids Research, 32:e57 (2004), Tsourkas A, Bao G., Shedding light on health and disease using molecular beacons, Briefings in Functional Genomics & Proteomics, 1:372-84 (2003), and Baker M B, Bao G, Searles C D., In vitro quantification of specific microRNA using molecular beacons, Nucleic Acids Research, 40:e13 (2012) each of which is hereby incorporated by refernece in its entirety.

Visually detectable markers suitable for use in the probes such as molecular beacons described herein include various enzymes, prosthetic groups, fluorescent markers, luminescent markers, bioluminescent markers, and the like. Examples of suitable fluorescent moieties include, but are not limited to, yellow fluorescent protein (YFP), green fluorescence protein (GFP), cyan fluorescence protein (CFP), umbelliferone, fluorescein, fluorescein isothiocyanate, rhodamine, dichlorotriazinylamine fluorescein, dansyl chloride, phycoerythrin and the like. Examples of suitable bioluminescent markers include, but are not limited to, luciferase (e.g., bacterial, firefly, click beetle and the like), luciferin, aequorin and the like. Examples of suitable enzyme systems having visually detectable signals include, but are not limited to, galactosidases, glucorinidases, phosphatases, peroxidases, cholinesterases and the like. Other suitable markers useful for molecular beacon design and probe design in general, are known to those of skill in the art.

Methods for incorporating detectable labels into nucleic acid probes are well known. Typically, detectable labels (e.g., as hapten- or fluorochrome-conjugated deoxyribonucleotides) are incorporated into a nucleic acid probe during a polymerization or amplification step, e.g., by PCR, nick translation, random primer labeling, terminal transferase tailing (e.g., one or more labels can be added after cleavage of the primer sequence), and others (see Ausubel et al., 1997, Current Protocols In Molecular Biology, Greene Publishing and Wiley-Interscience, New York).

Fluorescent labels and their attachment to oligonucleotides are described in many reviews, including Haugland, *Handbook of Fluorescent Probes and Research Chemicals*, Ninth Edition (Molecular Probes, Inc., Eugene, 2002); Keller and Manak, DNA Probes, 2nd Edition (Stockton Press, New York, 1993); Eckstein, editor, *Oligonucleotides and Analogues: A Practical Approach* (IRL Press, Oxford, 1991); Wetmur, *Critical Reviews in Biochemistry and Molecular Biology*, 26:227-259 (1991); and the like. Particular methodologies are disclosed in the following sample of references: Fung et al., U.S. Pat. No. 4,757,141; Hobbs, Jr., et al. U.S. Pat. No. 5,151,507; Cruickshank, U.S. Pat. No. 5,091,519. In one embodiment, one or more fluorescent dyes are used as labels, e.g., as disclosed by Menchen et al., U.S. Pat. No. 5,188,934 (4,7-dichlorofluorscein dyes); Begot et al., U.S. Pat. No. 5,366,860 (spectrally resolvable rhodamine dyes); Lee et al., U.S. Pat. No. 5,847,162 (4,7-dichlororhodamine dyes); Khanna et al., U.S. Pat. No. 4,318,846 (ether-substituted fluorescein dyes); Lee et al., U.S. Pat. No. 5,800,996 (energy transfer dyes); Lee et al., U.S. Pat. No. 5,066,580 (xanthine dyes): Mathies et al., U.S. Pat. No. 5,688,648 (energy transfer dyes); and the like. Labelling can also be carried out with quantum dots, as disclosed in the following patents and patent publications: U.S. Pat. Nos. 6,322,901; 6,576,291; 6,423,551; 6,251,303; 6,319,426; 6,426,513; 6,444,143; 5,990,479; 6,207,392; 2002/0045045; 2003/0017264; and the like. Amines can be incorporated into nucleic acid probes, and labels can be added via the amines using methods known in the art. As used herein, the term "fluorescent label" includes a signaling moiety that conveys information through the fluorescent absorption and/or emission properties of one or more molecules. Such fluorescent properties include fluorescence intensity, fluorescence life time, emission spectrum characteristics, energy transfer and the like. Exemplary labels include fluorescein amidite (FAM) and VIC which is a proprietary probe to Applera/Applied Biosystems.

Commercially available fluorescent nucleotide analogues readily incorporated into nucleic acid probes include, for example, Cy3-dCTP, Cy3-dUTP, Cy5-dCTP, Cy5-dUTP (Amersham Biosciences, Piscataway, N.J.), fluorescein-12-dUTP, tetramethylrhodamine-6-dUTP, TEXAS RED™-5-dUTP, CASCADE BLUE™-7-dUTP, BODIPY TMFL-14-dUTP, BODIPY TMR-14-dUTP, BODIPY TMTR-14-dUTP, RHODAMINE GREEN™-5-dUTP, OREGON GREENR™ 488-5-dUTP, TEXAS RED™-12-dUTP, BODIPY™ 630/650-14-dUTP, BODIPY™ 650/665-14-dUTP, ALEXA FLUOR™ 488-5-dUTP, ALEXA FLUOR™ 532-5-dUTP, ALEXA FLUOR™ 568-5-dUTP, ALEXA FLUOR™ 594-5-dUTP, ALEXA FLUOR™ 546-14-dUTP, fluorescein-12-UTP, tetramethylrhodamine-6-UTP, TEXAS RED™-5-UTP, mCherry, CASCADE BLUE™-7-UTP, BODIPY™ FL-14-UTP, BODIPY TMR-14-UTP, BODIPY™ TR-14-UTP, RHODAMINE GREEN™-5-UTP, ALEXA FLUOR™ 488-5-UTP, ALEXA FLUOR™ 546-14-UTP (Molecular Probes, Inc. Eugene, Oreg.). Protocols are available for custom synthesis of nucleotides having other fluorophores. Henegariu et al., "Custom Fluorescent-Nucleotide Synthesis as an Alternative Method for Nucleic Acid Labeling," *Nature Biotechnol*. 18:345-348 (2000).

Other fluorophores available for post-synthetic attachment include, inter alia, ALEXA FLUOR™ 350, ALEXA FLUOR™ 532, ALEXA FLUOR™ 546, ALEXA FLUOR™ 568, ALEXA FLUOR™ 594, ALEXA FLUOR™ 647, BODIPY 493/503, BODIPY FL, BODIPY R6G, BODIPY 530/550, BODIPY TMR, BODIPY 558/568, BODIPY 558/568, BODIPY 564/570, BODIPY 576/589, BODIPY 581/591, BODIPY 630/650, BODIPY 650/665, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethyl rhodamine, DYLIGHT™ DYES (e.g., DYLIGHT™ 405, DYLIGHT™ 488, DYLIGHT™ 549, DYLIGHT™ 594, DYLIGHT™ 633, DYLIGHT™ 649, DYLIGHT™ 680, DYLIGHT™ 750, DYLIGHT™ 800 and the like) (available from Thermo Fisher Scientific, Rockford, Ill.), Texas Red (available from Molecular Probes, Inc., Eugene, Oreg.), and Cy2, Cy3.5, Cy5.5, and Cy7 (available from Amersham Biosciences, Piscataway, N.J. USA, and others).

FRET tandem fluorophores may also be used, such as PerCP-Cy5.5, PE-Cy5, PE-Cy5.5, PE-Cy7, PE-Texas Red, and APC-Cy7; also, PE-Alexa dyes (610, 647, 680) and APC-Alexa dyes.

Detection method(s) used will depend on the particular detectable labels used in the nucleic acid probes. In certain exemplary embodiments, labels may be detected by a microscope, a spectrophotometer, a tube luminometer or plate luminometer, x-ray film, a scintillator, a fluorescence activated cell sorting (FACS) apparatus, a microfluidics apparatus or the like.

When fluorescently labeled nucleic acid probes are used, fluorescence photomicroscopy can be used to detect and record the results of hybridization using routine methods known in the art. Alternatively, digital (computer implemented) fluorescence microscopy with image-processing capability may be used.

In certain exemplary embodiments, images of fluorescently labeled nucleic acid probes are detected and recorded using a computerized imaging system such as the Applied Imaging Corporation CytoVision System (Applied Imaging Corporation, Santa Clara, Calif.) with modifications (e.g., software, Chroma 84000 filter set, and an enhanced filter wheel). Other suitable systems include a computerized imaging system using a cooled CCD camera (Photometrics, NU200 series equipped with Kodak KAF 1400 CCD) coupled to a Zeiss Axiophot microscope, with images processed as described by Ried et al. (1992) *Proc. Natl. Acad. Sci. USA* 89:1388). Other suitable imaging and analysis systems are described by Schrock et al., supra; and Speicher et al., supra.

"Spectrally resolvable" in reference to a plurality of fluorescent labels means that the fluorescent emission bands of the labels are sufficiently distinct, i.e., sufficiently non-overlapping, that molecular tags to which the respective labels are attached can be distinguished on the basis of the fluorescent signal generated by the respective labels by standard photodetection systems, e.g., employing a system of band pass filters and photomultiplier tubes, or the like, as exemplified by the systems described in U.S. Pat. Nos. 4,230,558; 4,811,218, or the like, or in Wheeless et al., pgs. 21-76, in *Flow Cytometry: Instrumentation and Data Analysis* (Academic Press, New York, 1985). In one aspect, spectrally resolvable organic dyes, such as fluorescein, rhodamine, and the like, means that wavelength emission maxima are spaced at least 20 nm apart, and in another aspect, at least 40 nm apart. In another aspect, chelated lanthanide compounds, quantum dots, and the like, spectrally resolvable means that wavelength emission maxima are spaced at least 10 nm apart, and in a further aspect, at least 15 nm apart.

Methods described herein are useful in determining the presence of organisms having one or more polymorphisms within a population of organisms which include wild type organisms or organisms without the one or more polymorphisms. Organisms within the scope of the present disclosure include viruses, bacteria and fungi. Exemplary viruses include Influenza viruses, Hepatitis C virus, Dengue virus, West Nile virus, Ebola virus, Lassa virus and the like. One of skill will readily understand that this list is exemplary only and that other viruses are well known to and can be readily identified by those of skill in the art. Exemplary bacteria include *Staphylococcus aureus*/methicillin-resistant *S. aureus, Neisseria meningitides, Mycobacterium tuberculosis, Borrelia* species, *Streptococcus Pneumoniae, Chlamydia Trachomatis, Neisseria Gonorrhoeae* and the like. One of skill will readily understand that this list is exemplary only and that other bacteria are well known to and can be readily identified by those of skill in the art. Exemplary fungi include *Candida* species, *Aspergillus* species, *Histoplasma capsulatum, Cryptococcus neoformans, Cryptococcus gattii, Coccidioides immitis* and the like. One of skill will readily understand that this list is exemplary only and that other fungi are well known to and can be readily identified by those of skill in the art.

"Kit" refers to any system, materials or reagents for carrying out a method of the present disclosure. In the context of method described herein, a kit for identifying a particular polymorphism within a population of particular organisms may include assays, reaction reagents (e.g., primers, enzymes, etc. in the appropriate containers) and/or supporting materials (e.g., buffers, written instructions for performing the assay etc.). For example, kits include one or more enclosures (e.g., boxes) containing the relevant reaction reagents and/or supporting materials for assays or methods of the invention. Such contents may be delivered to the intended recipient together or separately. For example, a first container may contain an enzyme for use in an assay, while a second container contains primers.

In certain embodiments, methods of determining the sequence of one or more nucleic acid sequences of interest, if desired, are provided. Determination of the sequence of a nucleic acid sequence of interest can be performed using a variety of sequencing methods known in the art including, but not limited to, sequencing by hybridization (SBH), sequencing by ligation (SBL), quantitative incremental fluorescent nucleotide addition sequencing (QIFNAS), stepwise ligation and cleavage, fluorescence resonance energy transfer (FRET), molecular beacons, TaqMan reporter probe digestion, pyrosequencing, fluorescent in situ sequencing (FISSEQ), FISSEQ beads (U.S. Pat. No. 7,425,431), wobble sequencing (PCT/US05/27695), multiplex sequencing (U.S. Ser. No. 12/027,039, filed Feb. 6, 2008; Porreca et al (2007) *Nat. Methods* 4:931), polymerized colony (POLONY) sequencing (U.S. Pat. Nos. 6,432,360, 6,485,944 and 6,511,803, and PCT/US05/06425); nanogrid rolling circle sequencing (ROLONY) (U.S. Ser. No. 12/120,541, filed May 14, 2008), allele-specific oligo ligation assays (e.g., oligo ligation assay (OLA), single template molecule OLA using a ligated linear probe and a rolling circle amplification (RCA) readout, ligated padlock probes, and/or single template molecule OLA using a ligated circular padlock probe and a rolling circle amplification (RCA) readout) and the like. High-throughput sequencing methods, e.g., on cyclic array sequencing using platforms such as Roche 454, Illumina Solexa, AB-SOLiD, Helicos, Polonator platforms and the like, can also be utilized. High-throughput sequencing methods are described in U.S. Ser. No. 61/162,913, filed Mar. 24, 2009. A variety of light-based sequencing technologies are known in the art (Landegren et al. (1998) *Genome Res.* 8:769-76; Kwok (2000) *Pharmacogenomics* 1:95-100; and Shi (2001) *Clin. Chem.* 47:164-172).

According to certain aspects of the present disclosure, primers include forward primers and reverse primers. Each primer includes an adaptor region. Each primer may include a pan degenerate region. The adaptor region is a nucleic acid sequence which is the consensus sequence of the target nucleic acid of the organism of interest that is adjacent to a target nucleotide position, such as a polymorphism at the position, or a polymorphic sequence, such as a series of polymorphic nucleotides which may also include one or more wild type nucleotides. Consensus sequences can be determined using methods known to those of skill in the art. Briefly, a consensus may be constructed from the most frequent residues at each site (alignment column), so that the total fraction of rows represented by the selected residues in that column reaches at least a specified threshold. IUPAC ambiguity codes (such as R for an A or G nucleotide) are counted as fractional support for each nucleotide in the ambiguity set (A and G, in this case), thus two rows with R are counted the same as one row with A and one row with G. When more than one nucleotide is necessary to reach the desired threshold, this is represented by the best-fit ambiguity symbol in the consensus; for protein sequences, this will always be an X. In the case of ties, either all or none of the involved residues will be selected. Hence, an alignment column with only A's and G's in equal number will be represented as an R in the consensus sequence regardless of the consensus threshold. See also additional information on determining a consensus sequence at world wide website assets.geneious.com/documentation/geneious/Geneious-Manual.pdf. Software for use in determining a consensus sequence is provided with reference to Bioinformatics, 2012 Jun. 15; 28(12):1647-9. doi: 10.1093/bioinformatics/bts199, Epub 2012 Apr. 27, Geneious Basic: an integrated and extendable desktop software platform for the organization and analysis of sequence data, Kearse M, Moir R, Wilson A, Stones-Havas S, Cheung M, Sturrock S, Buxton S, Cooper A, Markowitz S, Duran C, Thierer T, Ashton B, Meintjes P, Drummond A., Biomatters Ltd., 2/76 Anzac Avenue, Auckland, 1010, New Zealand and at world wide website ncbi.nlm.nih.gov/pubmed/22543367.

For a forward primer, the adaptor region is the consensus sequence of the sense strand of the target nucleic acid of the organism that is 5' to the target nucleotide. For the reverse primer, the adaptor region is the complement of the consensus sequence of the sense strand of the target nucleic acid of the organism that is 3' to the target nucleotide. According to certain aspects, the adaptor region includes between about 5 and about 10 nucleotides or between about 6 and about 9 nucleotides. According to one aspect, the adaptor region includes about 7 nucleotides.

According to one aspect, the pan degenerate region of the probes described herein includes a nucleic acid sequence which includes one or more degenerate nucleotides. Degenerate nucleotides or bases are well known to those of skill in the art. Exemplary degenerate bases are identified herein and in the literature.

According to certain aspects, a method of determining the presence of a polymorphism at one or more of a target nucleotide position in a plurality of target nucleic acid sequences, with each target nucleic acid sequence having a sense strand sequence and an antisense strand sequence, wherein the one or more of a target nucleotide position is flanked by a 5' flanking region and a 3' flanking region in each of the sense strand sequence and the antisense strand sequence including amplifying the target nucleic acid sequences to produce amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the amplicons have a sense strand amplicon and an antisense strand amplicon, wherein the sense strand amplicon includes a probe binding site including one or more of a target nucleotide at the one or more of a target nucleotide position with a 5' flanking region being the 3' adapter region sequence of the forward primer and with a 3' flanking region being the complement of the 3' adapter region sequence of the reverse primer, wherein the antisense strand amplicon includes a probe binding site including one or more of a target nucleotide at the one or more of a target nucleotide position with a 5' flanking region being the 3' adapter region sequence of the reverse primer and with a 3' flanking region being the complement of the 3' adaptor region of the forward primer, contacting the amplicons with sense-oriented nucleic acid probes or antisense-oriented nucleic acid probes including a label and having a probe sequence identical to the complement of the probe binding site, and detecting the label of hybridized nucleic acid probes.

According to certain aspects, the forward primer includes a pan degenerate region. According to certain aspects, the reverse primer further includes a pan degenerate region.

According to certain aspects, the plurality of target nucleotide sequences is a population of viral nucleic acids, bacterial nucleic acids, or fungal nucleic acids. According to certain aspects, the viral nucleic acids are viral RNA or viral DNA. According to certain aspects, the bacterial nucleic acids are bacterial RNA or bacterial DNA. According to certain aspects, the fungal nucleic acids are fungal RNA or fungal DNA.

According to certain aspects, the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position.

According to certain aspects, the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, wherein the polymorphism provides drug resistance.

According to certain aspects, the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable.

According to certain aspects, the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable, wherein the method further includes determining the relative amount of the wild type viral nucleic acids versus the mutated viral nucleic acids by comparing the detected labels.

According to certain aspects, the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable, wherein the method further includes determining the relative amount of the wild type viral nucleic acids versus the mutated viral nucleic acids by comparing the detected labels, wherein the relative amount is indicative of drug resistance of the population of viral nucleic acids.

According to certain aspects, the plurality of target nucleotide sequences is a population of viral nucleic acids including wild type viral nucleic acids with a wild type nucleotide at the one or more of a target nucleotide position and mutated viral nucleic acid with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable, wherein the method further includes determining the relative amount of the wild type viral nucleic acids versus the mutated viral nucleic acids by comparing the detected labels, wherein the relative amount is indicative of the presence of virulent versus non-virulent strains of virus.

According to certain aspects, the plurality of target nucleotide sequences is a population of viral nucleic acids with first viral nucleic acids having a first nucleotide at the one or more of a target nucleotide position indicative of a non-virulent strain of virus and mutated viral nucleic acids with the polymorphism at the one or more of a target nucleotide position indicative of a virulent strain of virus, and wherein the sense oriented nucleic acid probes or the antisense oriented nucleic acid probes include mutant detecting probes with a first label and wherein detecting the first label is indicative of the presence of the virulent strain of virus.

According to certain aspects, the forward primers and the reverse primers have constant adaptor regions and variable pan degenerate regions.

According to certain aspects, the nucleic acid probes include molecular beacons, hydrolysis probes, locked nucleic acid probes, FRET probes, scorpion probes and the like. One of skill will readily understand that this list is exemplary only and that other probes are well known to and can be readily identified by those of skill in the art.

According to certain aspects, the plurality of target nucleotide sequences is a population of HIV viral nucleic acid, HIV viral RNA, Newcastle disease viral DNA, hepatitis C viral DNA and the like. One of skill will readily understand that this list is exemplary only and that other target nucleotide sequences are well known to and can be readily identified by those of skill in the art.

According to certain aspects, the polymorphism at the one or more of a target nucleotide position is a single nucleotide polymorphism. According to certain aspects, the polymorphism at the one or more of a target nucleotide position is a substitution. According to certain aspects, the polymorphism at the target nucleotide position is a single nucleotide polymorphism. According to certain aspects, the polymorphism at the target nucleotide position is a substitution.

According to certain aspects, the 5' flanking region to the one or more of a target nucleotide position is between about 1 to about 10 nucleotides in length and wherein the 3' flanking region to the one or more of a target nucleotide position is between about 1 to about 10 nucleotides in length. According to one aspect, the 5' flanking region to the one or more of a target nucleotide position is between about 3 to about 8 nucleotides in length and wherein the 3' flanking region to the one or more of a target nucleotide position is between about 3 to about 8 nucleotides in length. According to certain aspects, the 5' flanking region to the one or more of a target nucleotide position is between about 6 to about 8 nucleotides in length and wherein the 3' flanking region to the one or more of a target nucleotide position is between about 6 to about 8 nucleotides in length. According to certain aspects, the 5' flanking region to the one or more of a target nucleotide position is about 7 nucleotides in length and wherein the 3' flanking region to the one or more of a target nucleotide position is about 7 nucleotides in length. According to one exemplary aspect, a flanking region of 10 nucleotides on either side of a primary polymorphism would designates a probe binding region of between 21 to 23 nucleotides, depending if the primary polymorphism is a substitution at 1, 2 or 3 nucleotide positions.

According to certain aspects, the sense oriented nucleic acid probe or the antisense oriented nucleic acid probe includes a complement to the nucleotide at the one or more of a target nucleotide position which is flanked by a 5' flanking region and a 3' flanking region. According to certain aspects, the sense oriented nucleic acid probe or the antisense oriented nucleic acid probe is an exact complement of the probe binding site of the amplicons.

According to certain aspects, the sense oriented nucleic acid probe or the antisense oriented nucleic acid probe is about 10 to about 20 nucleotides in length. According to certain aspects, the sense oriented nucleic acid probe or the antisense oriented nucleic acid probe is about 12 to about 15 nucleotides in length. According to certain aspects, the sense oriented nucleic acid probe or the antisense oriented nucleic acid probe is about 15 nucleotides in length.

According to certain aspects, the pan degenerate region can be any length depending on the complexity and GC content of the target nucleic acid and/or amplicon. According to one aspect, the pan degenerate region is between about 25 to about 50 nucleotides in length. According to certain aspects, the pan degenerate region is between about 28 to about 32 nucleotides in length. According to certain aspects, the pan degenerate region is about 30 nucleotides in length.

According to certain aspects, the label is a detectable label. According to certain aspects, the label is a fluorescent label. According to certain aspects, a plurality of spectrally resolvable labels are provide on a plurality of probes.

According to certain aspects, a method of mutating flanking regions of one or more of a target nucleotide position in a plurality of target nucleic acid sequences to provide a known probe binding site on amplicons, with each target nucleic acid sequence having a sense strand sequence and an antisense strand sequence, wherein the one or more of a target nucleotide position is flanked by a 5' flanking region and a 3' flanking region in each of the sense strand sequence and the antisense strand sequence including amplifying the target nucleic acid sequence to produce the amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the amplicons have the known probe binding site determined by the determined consensus sequences from the forward and reverse primers and the target nucleotide at the one or more of a target nucleotide position.

According to certain aspects, the forward primer further includes a pan degenerate region. According to certain aspects, the reverse primer further includes a pan degenerate region.

According to certain aspects, a polymorphism is present at the one or more of a target nucleotide position. According to certain aspects, a single nucleotide polymorphism is present at the one or more of a target nucleotide position.

According to certain aspects, a method of providing a known probe binding site sequence including one or more of a target nucleotide in amplicons of a plurality of target nucleic acid sequences, with each target nucleic acid sequence having a sense strand sequence and an antisense strand sequence, wherein one or more of a target nucleotide position is flanked by a 5' flanking region and a 3' flanking region in each of the sense strand sequence and the antisense strand sequence including amplifying the target nucleic acid sequence to produce the amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the known probe binding site of the amplicons is determined by the determined consensus sequences from the forward and reverse primers and the target nucleotide at the one or more of a target nucleotide position.

According to certain aspects, the forward primer further includes a pan degenerate region. According to certain aspects, the reverse primer further includes a pan degenerate region.

According to certain aspects, the one or more of a target nucleotide is a polymorphism. According to certain aspects, the one or more of a target nucleotide is a single nucleotide polymorphism.

According to certain aspects, a method of removing secondary polymorphisms flanking one or more of a target nucleotide position in a plurality of target nucleic acid sequences to provide a known probe binding site in amplicons, with each target nucleic acid sequence having a sense strand sequence and an antisense strand sequence, wherein the target nucleotide position is flanked by a 5' flanking region and a 3' flanking region in each of the sense strand sequence and the antisense strand sequence including amplifying the target nucleic acid sequence to produce the amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the amplicons have the known probe binding site determined by the determined consensus sequences from the forward and reverse primers and the target nucleotide at the one or more of a target nucleotide position.

According to certain aspects, the forward primer further includes a pan degenerate region. According to certain aspects, the reverse primer further includes a pan degenerate region.

According to certain aspects, a polymorphism is present at the one or more of a target nucleotide position. According to certain aspects, a single nucleotide polymorphism is present at the one or more of a target nucleotide position.

According to certain aspects, a method of determining drug resistance of a plurality of target nucleic acid sequences of viral nucleic acids wherein the presence of a polymorphism at one or more of a target nucleotide position indicates a drug resistant strain and wherein the viral nucleic acids including wild type viral nucleic acids, with each target nucleic acid sequence having a sense strand sequence and an antisense strand sequence, wherein the target nucleotide position is flanked by a 5' flanking region and a 3' flanking region in each of the sense strand sequence and the antisense strand sequence including amplifying the target nucleic acid sequence to produce amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the amplicons have a known probe binding site determined by the determined consensus sequences from the forward and reverse primers and the target nucleotide at the one or more of a target nucleotide position, contacting the amplicons with wild type sense oriented probes with a first label and mutant detecting probes with a second label and where the first label and the second label are spectrally resolvable, wherein the method further includes determining the relative amount of the wild type viral nucleic acids versus the mutated viral nucleic acids by comparing the detected labels of hybridized wild type sense oriented probes and hybridized mutant detecting probes, wherein the relative amount is indicative of drug resistance of the population of viral nucleic acids.

According to certain aspects, the forward primer further includes a pan degenerate region. According to certain aspects, the reverse primer further includes a pan degenerate region.

According to certain aspects, a method of characterizing mutant strains of a plurality of target nucleic acid sequences of viral nucleic acids wherein the presence of a polymorphism at one or more of a target nucleotide position indicates a mutant strain and wherein the viral nucleic acids including wild type viral nucleic acids, with each target nucleic acid sequence having a sense strand sequence and an antisense strand sequence, wherein the target nucleotide position is flanked by a 5' flanking region and a 3' flanking region in each of the sense strand sequence and the antisense strand sequence including amplifying the target nucleic acid sequence to produce amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the amplicons have a known probe binding site determined by the determined consensus sequences from the forward and reverse primers and the target nucleotide at the one or more of a target nucleotide position, contacting the amplicons with mutant detecting probes with a label, and detecting the label to indicate the presence of a mutant strain.

According to certain aspects, the forward primer further includes a pan degenerate region. According to certain aspects, the reverse primer further includes a pan degenerate region.

According to certain aspects, a probe is provided having a nucleic acid sequence identical to a target sequence of a target nucleotide, a 5' flanking region and a 3' flanking region, wherein the 5' flanking region is a consensus sequence for a 5' flanking region of a target nucleotide position in a viral nucleic acid and wherein the 3' flanking region is a consensus sequence for a 3' flanking region of the target nucleotide position in the viral nucleic acid. According to certain aspects, the target nucleotide is a polymorphism. According to certain aspects, the target nucleotide is a single nucleotide polymorphism.

According to certain aspects, a forward primer for nucleic acid amplification is provided having a 3' adaptor region, wherein the 3' adaptor region is a determined consensus sequence for a 5' flanking region of a target nucleotide position in a sense strand. According to certain aspects, the forward primer includes a pan degenerate region.

According to certain aspects, a reverse primer for nucleic acid amplification is provided having a 3' adaptor region, wherein the 3' adaptor region is complementary to a determined consensus sequence for a 3' flanking region of a target nucleotide position in a sense strand. According to certain aspects, the reverse primer includes a pan degenerate region.

According to certain aspects, primers for nucleic acid amplification are provided including a forward primer having a 3' adaptor region and a pan degenerate region, wherein the 3' adaptor region is a determined consensus sequence for a 5' flanking region of a target nucleotide position in a sense strand, and a reverse primer for nucleic acid amplification including a 3' adaptor region and a pan degenerate region, wherein the 3' adaptor region is complementary to a determined consensus sequence for a 3' flanking region of a target nucleotide position in the sense strand.

It is to be understood that the embodiments of the present invention which have been described are merely illustrative of some of the applications of the principles of the present invention. Numerous modifications may be made by those skilled in the art based upon the teachings presented herein without departing from the true spirit and scope of the invention. The contents of all references, patents and published patent applications cited throughout this application are hereby incorporated by reference in their entirety for all purposes.

The following examples are set forth as being representative of the present invention. These examples are not to be construed as limiting the scope of the invention as these and other equivalent embodiments will be apparent in view of the present disclosure, figures tables and accompanying claims.

Example I

Standard Criteria for Probe Design

According to certain aspects, a molecular probe can be used in the methods described herein with the molecular probe incorporating one or more modifications that permit a high $T_m$ for short oligonucleotides. An exemplary molecular probe is a TaqMan probe with a minor grove binding protein, or a probe that includes one or more locked nucleic acids (LNAs).

An optimal length for a probe is about 12 to 15 nucleotides, but depending on the GC % of the probe sequence, the length of the probe may fall outside of this range in order to achieve a $T_m$ between 60° C. and 65° C. The $T_m$ of the probe may also fall outside of this range, but the $T_m$ at which probe sensitivity and specificity are adversely affected is determined empirically.

According to one aspect, where the target nucleotide is a single nucleotide polymorphism ("SNP"), the SNP may be placed in the center of the probe, but may also be placed towards or at the 3' end of the probe. Placement at the 5' end may be disadvantageous as mismatches in this region are more likely to be tolerated which may result in reducing probe specificity.

To maximize the probability of the probe being completely complementary for the target probe binding site, the SNP flanking regions should be chosen based on the consensus sequence of all available target/pathogen genomes.

Depending on the fluorescence detection equipment, between 4 and 6 fluorophores can be used with a plurality of probes, allowing up to 6 target-specific molecular probes per each sample, e.g. a single sample can be used to detect drug resistance polymorphisms at three different codon positions simultaneously. For example a probe with label 1 is provided that detects the wild-type nucleotide at codon A, a probe with label 2 is provided that detects the drug resistance nucleotide at codon A, a probe with label 3 is provided that detects the wild-type nucleotide at codon B, a probe with label 4 is provided that detects the drug resistance nucleotide at codon B, a probe with label 5 is provided that detects the wild-type nucleotide at codon C, and a probe with label 6 is provided that detects the drug resistance nucleotide at codon C.

Example II

Standard Criteria for Primer Design

By using forward and reverse (sense and antisense) primers that overlap at their 3' termini with the probe flanking region immediately adjacent to the SNP, and are identical/complementary to the probe sequence (whether the 3' overlapping sequence is identical/complementary depends on the orientation of the primer and probe, e.g. a forward (sense) primer will have an identical sequence at its 3' end to the 5' flanking region of a sense oriented probe, and the reverse (antisense) primer will have a complementary sequence at its 3' end to the 3' flanking region of the same sense oriented probe. Ultimately the primers will perform mutagenesis on the flanking regions of the probe-binding site, altering them such that there are no secondary polymorphisms that could impact probe hybridization.

Furthermore, the primers will attempt to bind to a highly polymorphic template containing mismatches that constrain primer/template hybridization. To account for: 1) the adaptation of the template to match the probe sequence and 2) the high degree of variability that will occur in the primer-binding sites, primer design includes an adaptor region and a pan degenerate region.

The adaptor region includes nucleotides of the primer that overlap with the site on the template/PCR amplicon where the molecular probe binds. Dependent on the orientation of the primer and probe (sense or antisense), the overlap sequence in the adaptor region will be identical to, or complementary to, the probe sequence.

The nucleotides in the adaptor region of the primer may not be complementary to the template. The purpose of the adaptor region is to mutagenize the template so that newly synthesized amplicons contain a probe-binding site that is perfectly complementary to the probe sequence.

Ultimately this compensates for any secondary polymorphisms that may be present in the probe-binding region of the template, which might otherwise prevent hybridization. By using both forward and reverse primers that perfectly match the SNP flanking regions of the probe, a schematic example of which is shown in FIG. 1, the forward and reverse primers will alter the template and subsequently provide a perfect match for the probe, without altering the SNP of interest. An exemplary process is shown and described in FIG. 3.

The 3' adaptor region of the primer may contain mismatches with the template, which are necessary for its function. Although mismatches between the 3' adaptor region of the primer and the 5' flanking region of the target nucleic acid generally prevent oligonucleotide binding, a longer primer including mixed or degenerate bases, referred to herein pan degenerate primers, can overcome this unfavorable binding. Generally speaking, if the 3' ends of the primers match the probe sequence, and the probe sequence (and therefore the primers) is mismatched to target, secondary polymorphisms could theoretically also prevent primer binding.

As generally known, longer oligonucleotides may tolerate mismatches with the target. Therefore, to compensate for the mismatches in the probe-binding region between the primers and template, the primer can be lengthened to make hybridization more favorable.

Although lengthening the primer increases the possibility of encountering additional polymorphic nucleotides, such polymorphic nucleotides are inconsequential in terms of probe hybridization as they lie outside of the probe-binding region. Also, degenerate bases are used to accommodate polymorphisms which may be present outside of probe binding site. For example, if a particular nucleotide in the primer-binding region, but not the probe-binding region, is a C in one strain and a T in another, we can introduce the base Y into the primer design. It is common practice by which to identify that a synthesized oligonucleotide will contain 50% T at that position and 50% C-essentially two identical primers would be synthesized that differ only at the single polymorphic position, resulting in a pool with a 1:1 ratio of primers containing C or T. Exemplary degenerate bases are identified in the table below and are known to those of skill in the art.

a particular position. For example: if 96% of sequences contain A at a given position, and 4% contain G, the 95% consensus will encode for A. If 94% of sequences contain A, and 6% contain G, the 95% consensus will encode R, representing the presence of both bases. With the 95% consensus, any nucleotide present at a given position with ≥5% frequency will be included in the final sequence. Other consensus sequence variations e.g. 90%, 85%, could be used, and their efficiency can be determined empirically. Accordingly, one of skill will be able to utilize a consensus sequence of various percentages so long as the primer degenerate region sufficiently binds to the template to help stabilize the binding of the adaptor region to the template, if needed. A majority consensus sequence will give one the most frequent nucleotide, at any given position on a nucleic acid strand, from an alignment of sequences from the same species. A 95% consensus sequence will provide one with the nucleotide at each position which is present in at least 95% of sequences from the same species. An 85% consensus

TABLE 1

Degenerate Bases Code Table

| Code | N | V | B | H | D | K | S | W | M | Y | R |
|---|---|---|---|---|---|---|---|---|---|---|---|
| Bases | A/C/G/T | G/A/C | G/T/C | A/T/C | G/A/T | G/T | G/C | A/T | A/C | C/T | A/G |

By analyzing sequencing databases known to those of skill in the art for particular target nucleic acids, the frequency of various polymorphisms can be calculated and where degenerate bases are to be introduced can be accurately determined. According to one aspect, a pool of degenerate primers is provided that are all identical in their 3' adaptor region to match the probe, while being polymorphic in their pan degenerate region. According to this aspect, the pan degenerate region helps to stabilize binding of the 3' adaptor region should there be mismatches between the 3' adaptor region and the template. Primers described herein having a degenerate region or sequence, which is understood to be a sequence having one or more degenerate bases, improve primer binding.

Using as an example the primer 5'-CAR YTA GGR ATA CCD CAY CCH GCR GGD YTR-3' (SEQ ID NO:19,249), the degeneracy of the primers (i.e. the number of different primer combinations that are possible using degenerate bases) is calculated by multiplying degenerate base frequency by the number of nucleotides that the degenerate base can result in. For the degeneracy of the example primer, it contains 4 different positions with R, 3 with Y, 2 with D, and 1 with H. R can be 2 nucleotides ("nts") (A or G); Y can be 2 nts (C or T); D can be 3 nts (G, A, or T); H can be 3nts (A, C, or T). Therefore, this exemplary primer has: (4×2)×(3×2)×(2×3)×(1×3)=8×6×6×3=864-fold degeneracy. As such, a synthesized primer would be a pool of 864 oligonucleotides corresponding to each of the possible combination of degenerate bases.

However, the introduction of a large number of degenerate bases may result in a primer combination that is complementary to other regions within the target genome. Such unintentional hybridization may consume reaction components, thereby reducing the efficiency of the amplification, such as by PCR, for the intended target. To address this issue according to one aspect, a consensus sequence is chosen, for example, the 95% consensus sequence is chosen—that is, the sequence representing 95% of the most frequent bases at sequence will provide one with the nucleotide at each position which is present in at least 85% of sequences from the same species.

According to one aspect, the primer and probe design advantageously avoids or reduced primer binding to probe. For example, as shown in FIG. 3, the SNP of interest is positioned in the middle of the probe. The forward and reverse primers alter different ends of the template, so there is only ever a partial overlap between the primer and the probe, with the overlap being insufficient for hybridization of the primer to the probe under hybridization conditions utilized in the method and described herein. For example, with a maximum of a 7 nucleotide match between the forward or reverse primer and probe, this length is too short to allow hybridization between oligonucleotides at the assay annealing temperature.

Given that the primers and probes compete at varying times for the same region of the target nucleic acid sequence in the methods described herein, a higher concentration of primers is used during the initial cycles of the amplification (for example by PCR) which allow the primers to bind more favorably than the probe. As the primers are depleted, the binding of the probe will increase. Also, the shorter probe may more easily hybridize to the target nucleic acid than the longer primer, so as the assay progresses the probe hybridization will increase.

According to one design consideration, the adaptor region, corresponding to the flanking regions of the probe-binding site, should be placed at the 3' termini of the forward (sense) and reverse (antisense) primers.

According to one design consideration, the sequence of the pan degenerate region should be designed to reflect the 95% consensus of target genome sequences. Alternatively, the sequence of the pan degenerate region should be designed to reflect between 80% and 95% consensus of target genome sequences.

According to one design consideration, an optimal primer $T_m$ range is between about 70° C. to about 80° C., but may vary due to primer degeneracy. One of skill will readily be able to determine a sufficient $T_m$ for a given primer sequence. A $T_m$ of the primer may be below 70° C. or above 80° C., as the $T_m$ at which probe sensitivity and specificity are adversely affected is readily determined by one of skill in the art.

According to certain aspects, homo- and hetero-dimers may form between the primers during amplification. The use of degenerate bases may increase dimer formation. Primer dimers can be extended by the DNA polymerase in a PCR reaction, leading to non-specific PCR product accumulation. In addition to consuming reaction components, primer dimer products can serve as templates—sometimes preferentially—in subsequent PCR cycles, which reduces the sensitivity of the PCR for the template of interest. See FIG. 6(1).

One variation of the primer design is the inclusion of a non-specific nucleotide sequence at the 5' terminus of the primer. The effect of this is two-fold: (1) The thermodynamics of hybridization between the 5' complementary sequences is more favorable than hybridization between primers at internal nucleotides. See FIG. 6(2). (2) Should either self-dimers or heterodimers form between the reaction primers, the reverse complement of the 5' non-specific sequence will be present at the 3' terminus of the newly synthesized molecule, which is entirely complementary to the primers present in the reaction. See FIG. 6(3) and FIG. 6(4). As intramolecular hybridization is more thermodynamically favorable than intermolecular hybridization, the product of primer dimerization should form a stem-loop structure that prevents it from further binding, and consuming, primers in the PCR reaction. See FIG. 6(5).

According to certain aspects, the 5' complementary sequence can be 4 to 10 nucleotides. An exemplary length is 5 to 8 nucleotides in length. An exemplary sequence is an 8 nucleotide palindrome CGCGCGCG. The 5' sequence can be any nucleotide sequence that is not complementary to the 5' primer-binding site of the template. A GC-rich sequence is preferable as the stem-loop structure is more likely to be stable at high assay temperatures due to the presence of three hydrogen bonds between guanine and cytidine. This also allows fewer nucleotides to be included in the 5' terminus of the primer, reducing the possibility of complementarity with the template.

Example III

Probe Design for Detection of HIV-1 K103N Polymorphism

Methods described herein are suitable for the detection of drug resistance strains in HIV-1. One of skill will readily understand that the methods described herein can also be used with other viruses such as hepatitis C virus.

The change from AAA to AAC or AAT at the 103 codon of HIV-1 reverse transcriptase confers resistance to the drug nevirapine, which is a non-nucleoside reverse transcriptase inhibitor (NNRTI) in widespread use globally. This single base change results in a substitution of lysine (K) with asparagine (N).

HIV subtypes are defined by their genetic dissimilarities, differing from one another by 10% to 12% of their nucleotides. Globally, subtype C accounts for 50% of infections, whereas subtype A accounts for 12%, subtype B accounts for 10%, subtype G accounts for 6%, and subtype D accounts for 3% of infections.

A 15 nucleotide TaqMan-MGB probe was designed to have a melting temperature ($T_m$) (the temperature at which the probe will dissociate from the target oligonucleotide) of 62° C. to 64° C. The SNP A/C/T was placed in the center of the probe, with 7 nts flanking either side of the SNP.

Given the heterogeneity of HIV genomes, the flanking sequences were determined based on the consensus (most frequently observed) nucleotides at those positions from 4,291 HIV sequences. As shown in the table below, 71.22% (n=4,291) of HIV-1 poi sequences in the Los Alamos database are identical for a 15nt region that covers the 103 SNP (AAA/C/T). 23.91% have 1 mismatch, 4.12% have 2 mismatches, and 0.58% have 3 mismatches. Only 0.16% have >3 mismatches.

Thus, the probe sequence 5'-AAA AGA AAA AAT CAG-3' (SEQ ID NO:19,250) would be a perfect match for >70% of targets. However, almost a third of strains/patients samples would return a false negative result when probing for the drug resistance SNP (A C/T).

TABLE 2

| aaaagaaAaaatcag (SEQ ID NO: 19,251) | n | freq |
|---|---|---|
| ............... | 3056 | 71.22% |
| .........G.... | 210 | 4.89% |
| .G............ | 145 | 3.38% |
| ......G....... | 121 | 2.82% |
| ...G.......... | 65 | 1.51% |
| ..C........... | 64 | 1.49% |
| .........G.... | 62 | 1.44% |
| .......G...... | 51 | 1.19% |
| .......C...... | 43 | 1.00% |
| .............A | 37 | 0.86% |

Example IV

Probe Design for Differentiation of Pathogenic and Non-Pathogenic Newcastle Disease Virus For the detection of pathogens, or differentiation between two strains, where there may be no need to quantify any genetic variability that is present in a sample, then a qualitative approach can be used. Newcastle disease virus outbreaks require the distinction between virulent and non-virulent strains, which are determined by the presence of a particular amino acid conserved in virulent strains but absent in non-virulent strains. One of skill in the art will readily envision it beneficial to identify whether other viruses are virulent or non-virulent and that the present disclosure is not limited to Newcastle disease virus.

The equipment needed for qualitative detection is less specialized, as it does not require a real-time PCR thermal cycler to constantly measure fluorescence as the reaction proceeds. By measuring background fluorescence with a small benchtop fluorometer before performing a standard PCR, the presence or absence of a change in fluorescence after PCR will give a "yes/no" answer for pathogen detection. This approach is advantageous for point-of-care diagnostics.

Newcastle disease virus (NDV) strains can be split into three pathotypes: velogenic and mesogenic, which are highly virulent, and lentogenic, which have low virulence. The presence of virulent strains requires extensive eradication of infected areas as the mortality rate is >90%. Low virulence strains only require additional monitoring as these strains generally cause subclinical disease with very low mortality.

Pathotypes can be distinguished from each other by determining the sequence of the fusion cleavage site. In virulent strains (velogenic and mesogenic), the fusion amino acid sequence is conserved as $^{112}$RRKKRF$^{117}$ (SEQ ID NO:19,252) allowing the differentiation with non-virulent strains. Current qRT-PCR tests demonstrate both efficiency and effectiveness, with good sensitivity and specificity, and can identify most but not all virulent viruses in the test panels used for validation. Upon analysis of sequences from virulent (n=2,217) and non-virulent (n=641) strains of NDV, methods described herein can differentiate between strains, including novel variants that might arise in the future, even where NDV detection may be difficult due to the genomic diversity.

The fusion cleavage point is a suitable region to target to differentiate between virulent (velogenic and mesogenic) and non-virulent (lentogenic) pathotypes. Virulent pathotypes encode a phenylalanine at the cleavage site, of which TTT/C are the only codons, while non-virulent pathotypes encode leucine, encoded by TTA/G and CTA/T/C/G.

To account for the genetic variation in codons for leucine and phenylalanine, there are six possible probes for non-virulent strains, and two for virulent strains. Using the degenerate base code, these probes can be shown as:

```
Pathogenic:
                                    (SEQ ID NO: 19,253)
AAA CGC TTY ATA GGT G Non-pathogenic:
                                    (SEQ ID NO: 19,254)
GGG CGC CTN ATA GG (SEQ ID NO: 19,255)
GGG CGC TTR ATA GG
```

The flanking regions of the probes (underlined) correspond to the most frequently observed nucleotides for pathogenic and non-pathogenic NDV, respectively. The probe for pathogenic NDV is 16 nucleotides, with a $T_m$ of 63° C. for the TTT probe and 66° C. for the TTC probe. For non-pathogenic NDV they are 14 nucleotides, with a $T_m$ range from 65° C. to 69° C. for the CTN probe, and 64° C. to 67° C. for the TTR probe.

Example V

Primer Design for Detection of HIV-1 K103N Polymorphism

Figure 4:
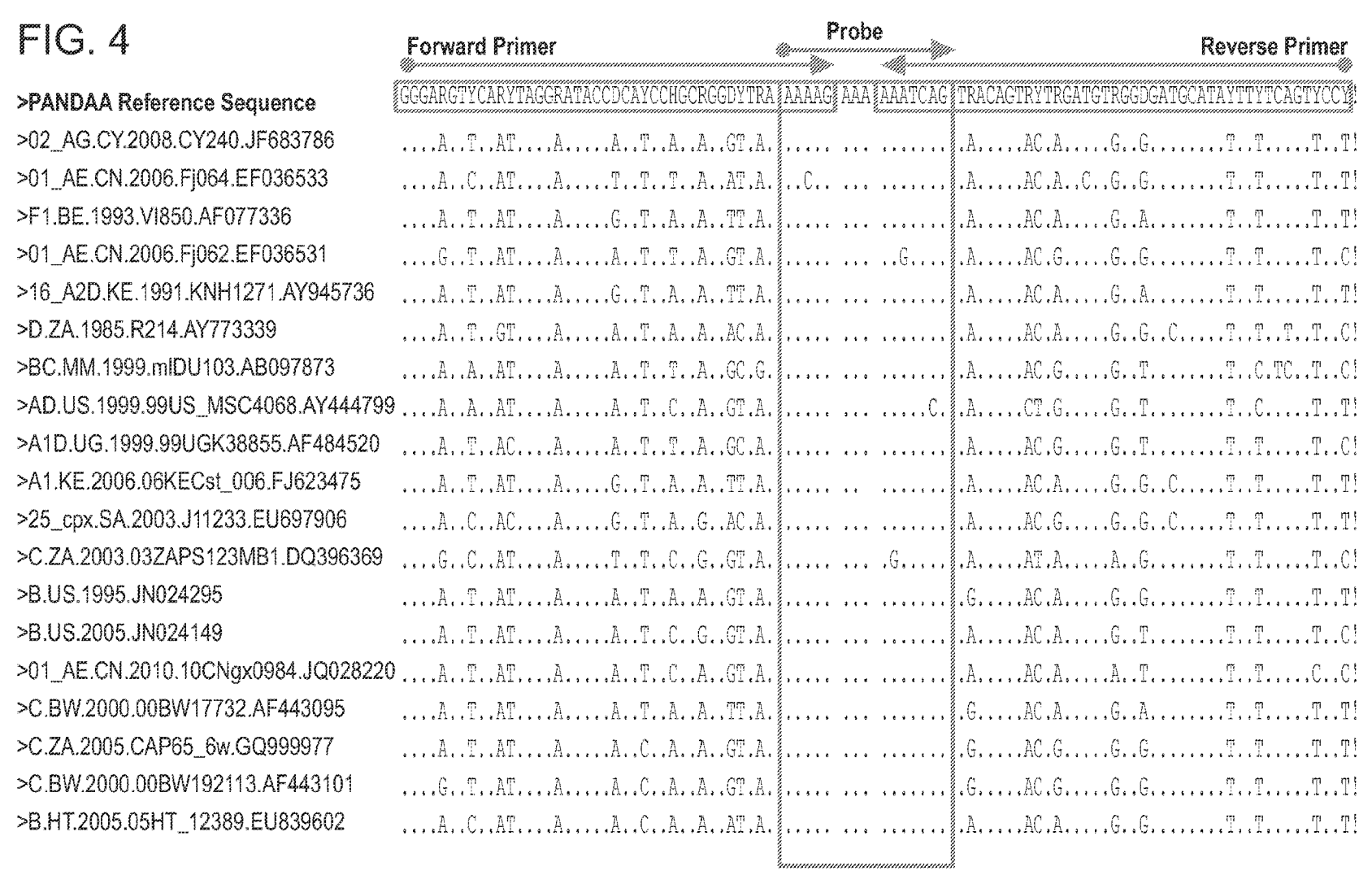

Oligonucleotide primers having an adaptor region and a degenerate region were designed to allow for the template amplification and adaptation of a plurality of HIV subtype as shown in FIG. 4.

As stated, primer design involves a 3' adaptor region overlapping the probe target region, and an extended pan degenerate region that compensates for thermodynamic instability that may arise from 3' mismatches (adaptor regions in bold). The sequences for the PDR are derived from the 95% consensus of sequences publically available from online databases:

```
K103 Forward:
                                    (SEQ ID NO: 19,256)
5'-CAR YTA GGR ATA CCD CAY CCH GCR GGD YTR A
AAAAG-3'

K103 Reverse:
                                    (SEQ ID NO: 19,257)
3'-AAATCAG TR ACA GTR YTR GAT GTR GGD GA-5'
```

For the forward primer degeneracy, it contains 4 different positions with R, 3 with Y, 2 with D, and 1 with H. R can be 2nts (A or G); Y is 2nts (C or T); D is 3nts (G, A, or T); H is 3nts (A, C, or T). Therefore, the forward primer has: (4×2)×(3×2)×(2×3)×(1×3)=8×6×6×3=864 primer variations; the reverse primer has 96 primer variations.

Example VI

Figure 5:
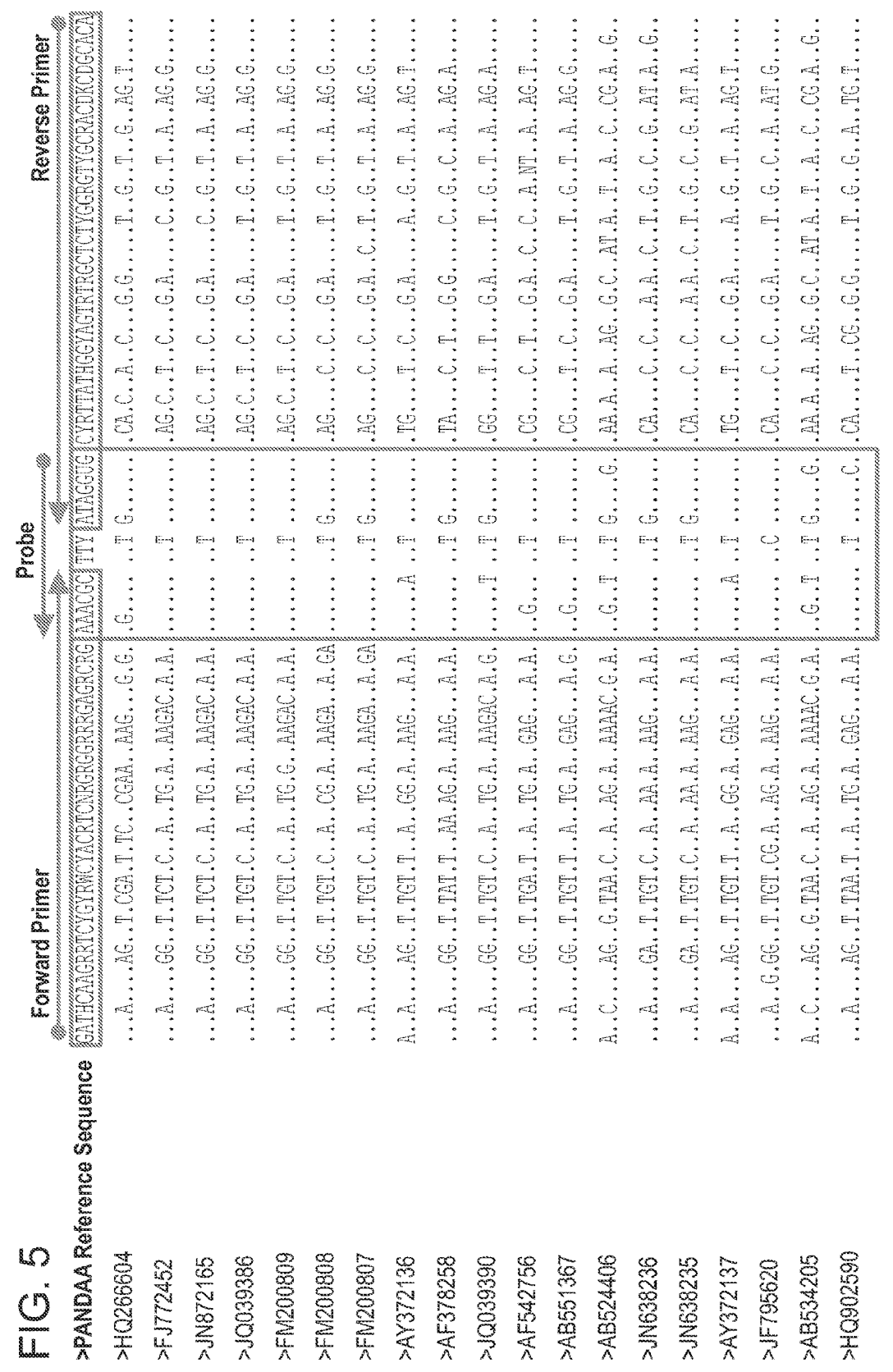

Primer Design for Differentiation of Pathogenic and Non-Pathogenic Newcastle Disease Virus Oligonucleotide primers having an adaptor region and a degenerate region were designed to allow for the template amplification and adaptation. Forward and reverse primers were selected for the template amplification and adaptation of pathogenic (velogenic and mesogenic) strains of NDV (adaptor regions in bold). See FIG. 5.

```
NDV Forward:
                                    (SEQ ID NO: 19,257)
5'-G ATH CAA GRR TCY GYR WCY ACR TCN RGR GGR RRG
AGR CRG AAACGC-3'

NDV Reverse:
                                    (SEQ ID NO: 19,258)
3'-ATAGGTG CY RTT ATH GGY AGT RTR GCT CTY GGR GTY
GCR ACD KCD GCA CA-5'
```

The forward primer has 786,432-fold degeneracy; the reverse primer has 27,648-fold degeneracy.

Example VII

Assay and Reaction Conditions

For the purposes of the experimental results presented here, the following reaction conditions were employed, although these are not absolute and can be further optimized for different conditions: A commercial qPCR master mix, Kapa probe fast qPCR kit master mix (2×) universal, was used in a 20 μl final reaction volume. The final primer concentration for both the forward (sense) and reverse (antisense) primers was 250 nM of each primer. The final probe concentration was 25 nM for each differentially labeled probe (FAM, VIC etc.)

qPCR cycling conditions were 95° C. for 3 minutes, followed by 40 to 50 cycles of 95° C. for 3 seconds and 60° C. for 60 seconds.

Fluorescence was detected during on the 60° C. step of the protocol, and readings were acquired using an ABI 7900HT real-time PCR machine. Fluorescence data were corrected for background fluorescence and the curve fitted with a five-parameter sigmoidal model.

A one-step qRT-PCR, a commercial reverse transcriptase enzyme is added to the final 20 μl reaction. Before the standard qPCR cycling conditions shown above, a 50° C. incubation for 15 minutes is performed so that a complementary DNA template can be synthesized from the input RNA template.

Example VIII

Detecting K103N Drug Resistance Polymorphism in HIV-1 pol

To confirm that the pan degenerate primers were able to bind to templates containing naturally occurring polymorphisms, a template known to contain mismatches to the primer binding sites determined by the majority consensus sequence was used:

```
Forward Standard Primer
                              (SEQ ID NO: 19,259)
5'-GGGAAGTTCAATTAGGAATACCACATCCAGCAGGGTTAAAAA
AG-3'

Template
                              (SEQ ID NO: 19,260)
5'-GGGAGGTTCAATTAGGAATACCGCACCCAGCAGGGTTAAAAA
AG-3'

Reverse Standard Primer
                              (SEQ ID NO: 19,261)
3'-AAATCAGTAACAGTACTGGATGTGGGTGATGCATATTTTCA
GTTCCT-5'

Template
                              (SEQ ID NO: 19,262)
3'-AAATCAGTAACAGTATTAGATGTGGGGGATGCATATTTTCA
GTTCCT-5'
```

The probe-binding region contained the wild-type (AAA) 103 codon, and was perfectly matched to the PANDAA ("Pan Degenerate Amplification and Adaptation) K103 probe used in the methods described herein. Using serial dilutions of the template from $10^7$ to $10^3$ copies/reaction, standard primers were less sensitive at lower template copy numbers than the pan degenerate primers. See Table 3 below.

TABLE 3

|  | Standard | PANDAA | Fold |
|---|---|---|---|
| $10^7$ | 18.99 | 20.63 | 3.10 |
| $10^6$ | 22.27 | 23.89 | 3.08 |
| $10^5$ | 26.07 | 27.36 | 2.45 |
| $10^4$ | 31.69 | 31.16 | −1.45 |
| $10^3$ | 40.47 | 34.87 | −48.72 |

Figure 7A:
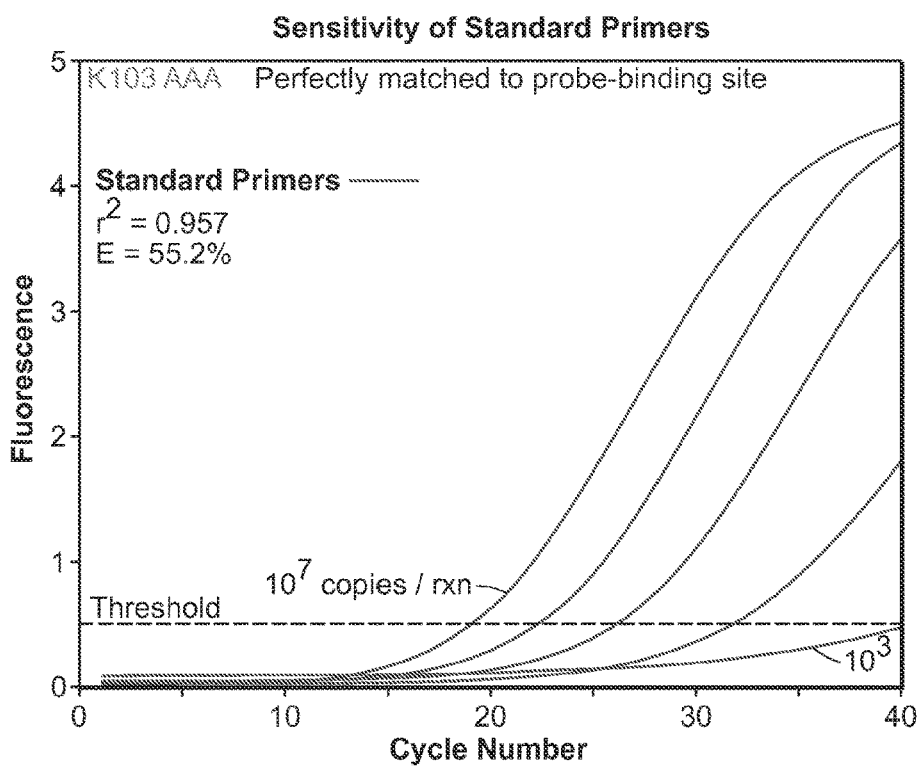

At $10^5$-$10^7$ copies of template per reaction, there was a sufficient concentration of template for the standard primers to overcome the primer/template mismatches, resulting in a ~2-3 fold increase in sensitivity over the PANDAA primers. See FIG. 7a.

Figure 7B:
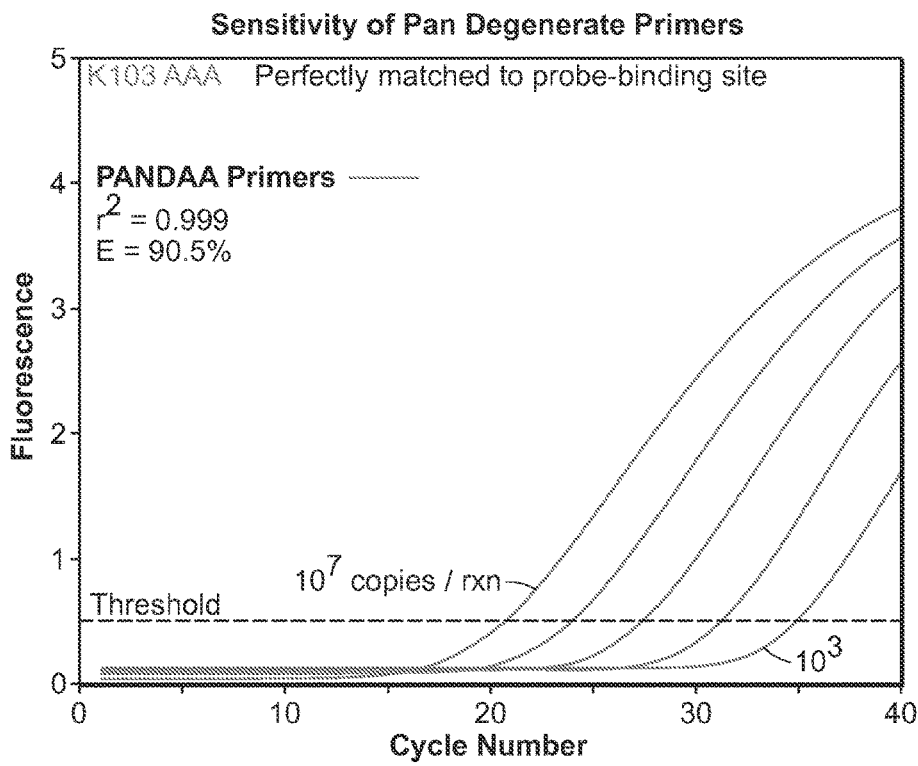
Figure 8A:
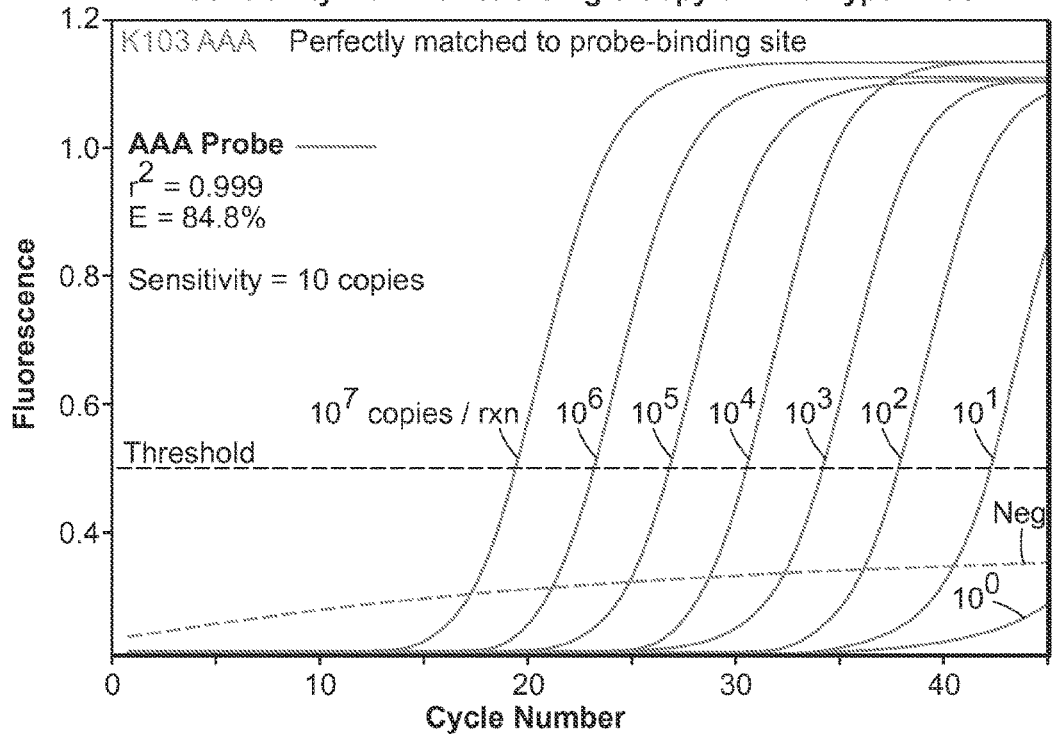
Figure 8B:
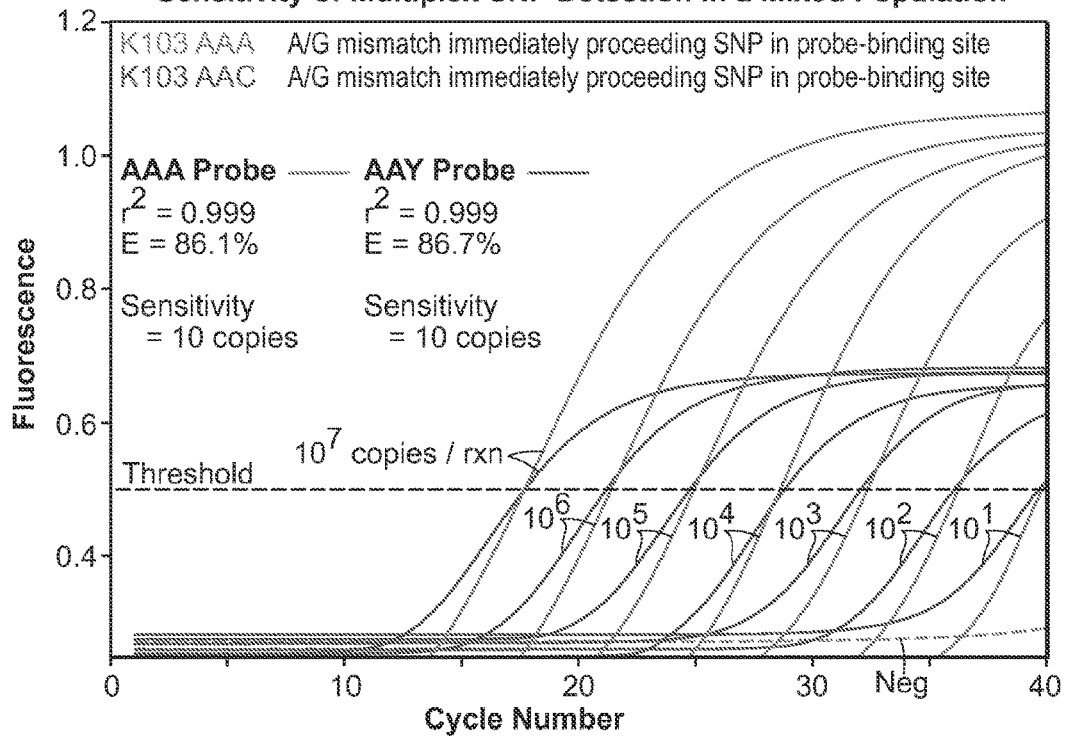
Figure 10:
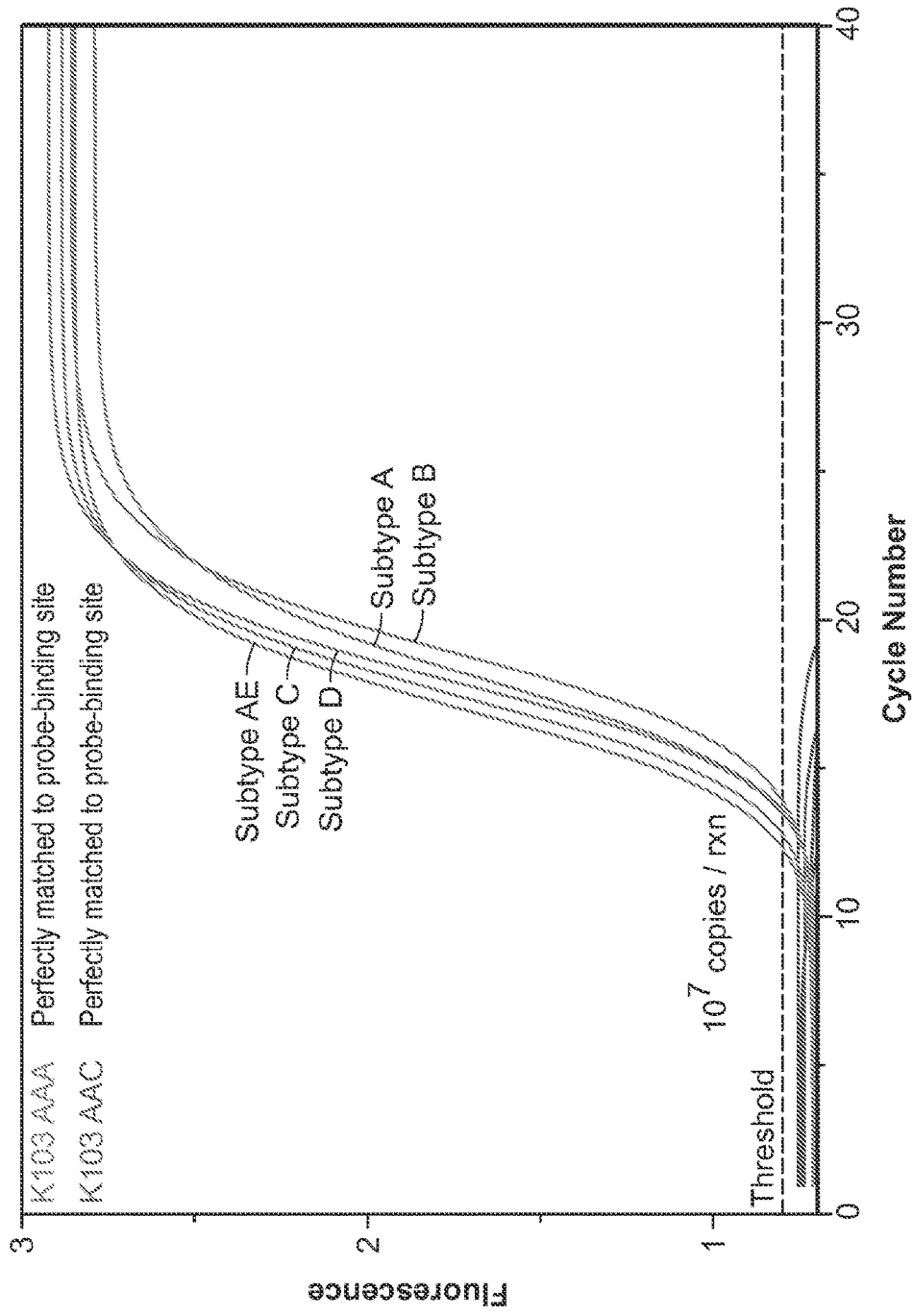
Figure 12:
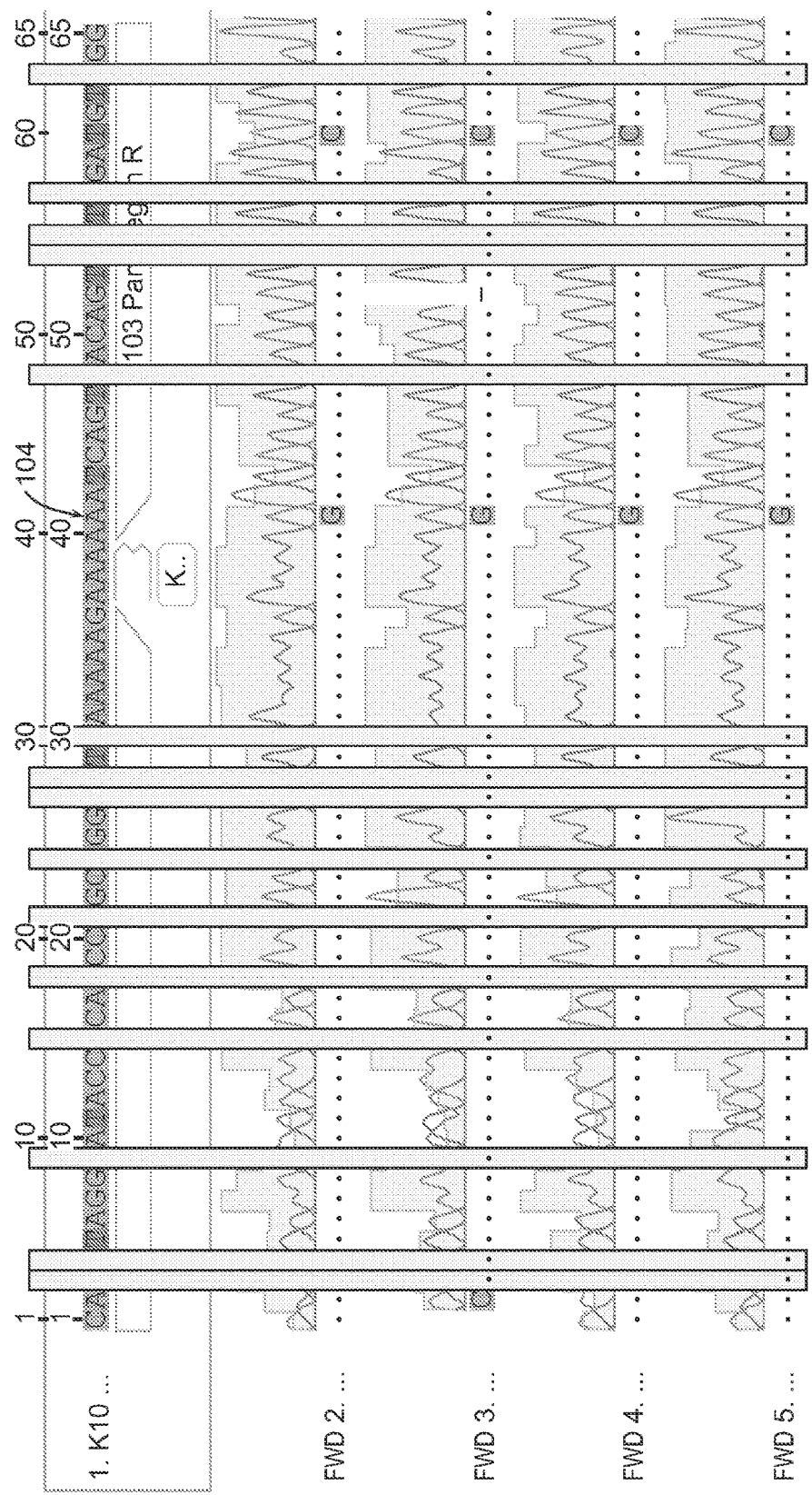

However, at $10^4$ copies/reaction, the efficiency of the standard primers dropped in comparison to the PANDAA primers, and by $10^3$ copies of template, the PANDAA primers were almost 50× more sensitive than the standard primer set. See FIG. 7b.

PANDAA is sensitive to at least 10 copies. Using the same template—with a perfectly complementary probe-binding site but containing mismatches in the primer-binding regions—a wild-type (AAA) template from $10^7$ copies to $10^0$ copies per reaction was titrated.

With a reaction efficiency of ~85%, the wild-type K103 SNP was detected at 10 copies/reaction over 45 cycles of PCR.

To determine whether the wild-type (AAA) and drug resistance mutation (AAC) could be distinguished in the same reaction, an AAA probe labelled with a FAM dye and an AAY (mixed AAC:AAT) probe labelled with a VIC dye were used.

Using a template that contained a mismatch with probe-binding site at codon 104, and also with the same mismatches in the primer-binding regions as previously described, both AAA and AAC was titrated from $10^7$ copies to $10^0$ copies per reaction, and present at a 1:1 ratio wild-type to mutant.

Over 40 cycles of PCR, both the AAA and AAY probes detected their respective templates with equal efficiency and sensitivity.

PANDAA methods described herein can detect multiple HIV subtypes with equal sensitivity. Using templates derived from the majority consensus sequences for HIV-1 subtypes A, AE, B, C, and D, the sensitivity of detection was determined using $10^7$ copies/reaction of each template, in the presence of both AAA and AAY probes, using pan degenerate primers.

As shown in FIG. 9, all nucleotide differences between subtypes—excluding a T/C polymorphism in subtype A found in the reverse primer alignment—occurred at degenerate nucleotides in the pan degenerate primers (highlighted in blue).

Using templates derived from the majority consensus sequences for HIV-1 subtypes A, AE, B, C, and D, the sensitivity of detection was determined using $10^7$ copies/reaction of each template, in the presence of both AAA and AAY probes, using pan degenerate primers.

Using a predetermined fluorescence value as a threshold, the sensitivity is determined by calculating the number of qPCR cycles (the cycle quantification (Cq) value) required for the reaction to reach that level of fluorescence. See Table 4 below.

TABLE 4

| Subtype | Cq |
|---|---|
| Subtype A | 13.49 |
| Subtype AE | 12.30 |
| Subtype B | 13.92 |
| Subtype C | 12.81 |
| Subtype D | 13.47 |

Although the input copy number of template was the same for all subtypes, detection of the target is initiated at different cycles of the qPCR depending on the location and number of polymorphisms for which the pan degenerate primers must compensate.

RNA may be used as a template for the PANDAA methods and reactions described herein which is useful for HIV which has an RNA genome. RNA undergoes an initial reverse transcription step to synthesize complementary DNA (cDNA), which is subsequently used as the template for qPCR.

A one-step qRT-PCR involves including a reverse transcriptase enzyme in the reaction along with the standard qPCR reaction components, and RNA as the template. Using the PANDAA primers described herein, cDNA will be reverse transcribed from the RNA before the reaction subsequently proceeds to qPCR, without any additional handling by the user.

$10^5$ copies of RNA containing the wild-type K103 codon (AAA), a mismatch with probe-binding site at codon 104, and also with the same mismatches in the primer-binding regions as previously described, was used in the one-step qRT-PCR in a parallel with a synthetic DNA template of the same sequence, titrated from $10^7$ copies to $10^3$ copies per reaction. As shown in FIG. 11, reverse transcriptase enzymes from various commercial suppliers performed differently, but 3 of the 6 enzymes resulted in the detection of the AAA K103 codon from RNA with the same sensitivity as using a DNA template.

PANDAA methods described herein can be used to adapt the template to match the probe-binding sequence. Using pan degenerate primers, a mismatch was intentionally introduced in the probe-binding region of a template with a probe-binding site that was completely complementary to the probe. By introducing a change at the 104 codon, the secondary polymorphism abolished probe binding.

No fluorescence was detected using primers that altered the probe-binding sequence to introduce a mismatched nucleotide, compared to primers that perfectly matched the probe sequence.

Upon sequencing of the PCR product, the template had changed to contain a G substitution at the 104 codon position, confirming that PANDAA methods described herein change the probe-binding region.

The use of degenerate primers in the primer-binding region also altered the template. These changes have no impact on probe binding, but recapitulates that use of degenerate bases is an advantageous approach to compensate for intentional mismatches in the 3' end of the primers designed to alter the probe-binding region.

Example IX

Differentiation of Pathogenic and Non-Pathogenic Newcastle Disease Virus

Pan degenerate primers are useful for differentiating between virulent and non-virulent strains. The fusion cleavage point is a region of Newcastle Disease Virus (NDV) that can be targeted to differentiate between virulent (velogenic and mesogenic) and non-virulent (lentogenic) pathotypes. Virulent pathotypes encode a phenylalanine at the cleavage site, of which TTT/C are the only codons, while non-virulent pathotypes encode leucine, encoded by TTA/G and CTA/T/C/G.

To determine the effectiveness of PANDAA methods described herein in detecting NDV, the sensitivity of the assay to detect two strains of pathogenic NDV: Dove/Italy/2736/00 and Game fowl/US(CA)/211472/02 was compared. The Dove strain has a probe-binding site perfectly matched to the PANDAA probe, whereas the Game fowl strain has an A/G mismatch at the nucleotide immediately after the SNP.

Figure 13:
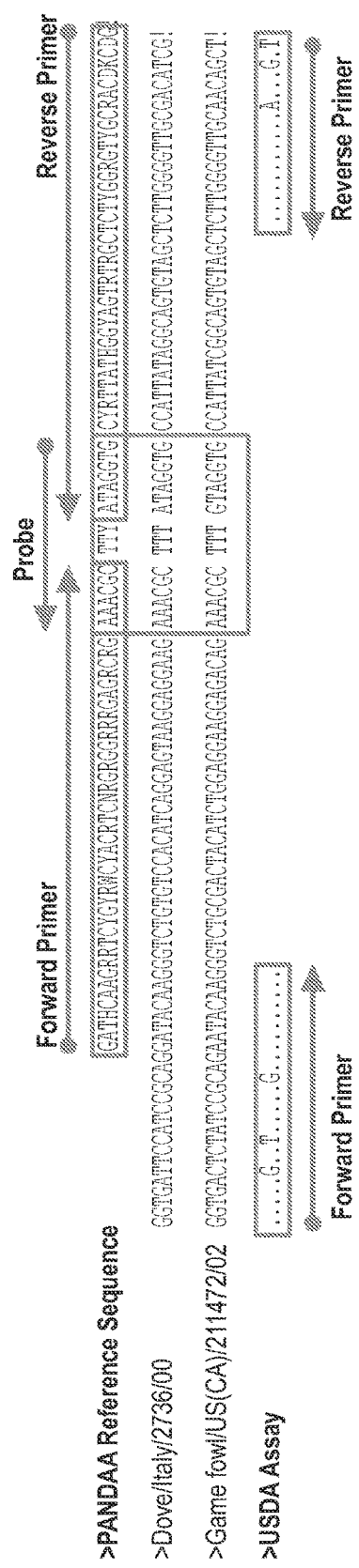

Two primer sets were compared: the PANDAA primers—designed to alter the probe-binding region—and the primers currently used in a US Department of Agriculture (USDA) NDV detection assay, which hybridize outside of the probe-binding region. See FIG. 13.

With the Dove/Italy/2736/00 template, which does not require any adaptation of the probe-binding site to match the probe sequence, both PANDAA and USDA primer sets detected NDV with similar efficiencies, although the PANDAA primers were found to be ~10-fold more sensitive. See FIG. 14.

Game fowl/US(CA)/211472/02, requiring a G to A adaptation in the probe-binding region, was detected by PANDAA methods described herein at a similar reaction efficiency as the Dove/Italy/2736/00 template. However, compared to the USDA primers, the PANDAA method was >1,000-fold more sensitive, detecting as few as 1,000 copies of template. See FIG. 14.

Example X

Primer and Probe Design for 81 Codons in the Reverse Transcriptase, Protease and Integrase Genes of HIV-1

This example discloses 2,701 forward primers, 2,813 reverse primers, 6,691 probes to detect wild-type sequences, and 7,043 probes to detect drug resistance sequences according to certain aspects of the invention. Mutations (e.g., substitutions, deletions and/or additions) at specific amino acid positions of HIV-1 reverse transcriptase protein, HIV-1 integrase protein and/or HIV-1 protease protein described herein can be used to identify HIV-1 drug resistance.

Table 5 depicts forward and reverse primers for the HIV-1 reverse transcriptase gene. A "+" symbol preceding a nucleotide denotes that the nucleotide is an LNA.

TABLE 5

| Codon | Forward Primer (5' to 3') |
|---|---|
| 40 | CCATTRACAGAAGARAAAATAAAAGCMTTARYAGMMATYTGTACA (SEQ ID NO: 1) |
| 40 | CCATTRACAGAAGARAAAATAAAAGCMTTARYAGMMATYTGTACA + N (SEQ ID NO: 2) |
| 41 | AAAATAAAAGCATTARYAGMMATTTGTRMDGAD (SEQ ID NO: 3) |
| 41 | ARAAAATAAAAGCATTARYAGMMATTTGTRMDGAD (SEQ ID NO: 4) |
| 41 | AGAAGARAAAATAAAAGCATTARYAGMMATTTGTRMDGAD (SEQ ID NO: 5) |
| 41 | GCATTARYAGMMATTTGTRMDGAD (SEQ ID NO: 6) |
| 41 | TAAAAGCATTARYAGMMATTTGTRMDGAD (SEQ ID NO: 7) |
| 41 | AAATAAAAGCATTARYAGMMATTTGTRMDGAD (SEQ ID NO: 8) |
| 41 | TTRACAGAAGARAAAATAAAAGCMTTARYAGMMATYTGTACAGAA (SEQ ID NO: 9) |
| 41 | AAAATAAAAGCATTARYAGMMATTTGTRMD GAD + N (SEQ ID NO: 10) |
| 41 | ARAAAATAAAAGCATTARYAGMMATTTGTRMDGAD + N (SEQ ID NO: 11) |
| 41 | AGAAGARAAAATAAAAGCATTARYAGMMATTTGTRMDGAD + N (SEQ ID NO: 12) |

TABLE 5 -continued

| | |
|---|---|
| 41 | GCATTARYAGMMATTTGTRMDGAD + N (SEQ ID NO: 13) |
| 41 | TAAAAGCATTARYAGMMATTTGTRMDGAD + N (SEQ ID NO: 14) |
| 41 | AAATAAAAGCATTARYAGMMATTTGTRMDGAD + N (SEQ ID NO: 15) |
| 41 | TTRACAGAAGARAAAATAAAAGCMTTARYAGMMATYTGTACAGAA + N (SEQ ID NO: 16) |
| 41 | +A + AAATAAAA + GCATTARYAGMMATTTGTRMD GAD (SEQ ID NO: 17) |
| 41 | +AAAA + TAAAA + GCATTARYAGMMATTTGTRMD GAD (SEQ ID NO: 18) |
| 41 | +A + AAA + TAAAAGCATTARYAGMMATTTGTRMDGAD (SEQ ID NO: 19) |
| 41 | +AR + AAAA + TAAAAGCATTARYAGMMATTTGTRMDGAD (SEQ ID NO: 20) |
| 41 | +ARA + AAA + TAAAAGCATTARYAGMMATTTGTRMDGAD (SEQ ID NO: 21) |
| 41 | +AR + A + AAATAAAAGCATTARYAGMMATTTGTRMDGAD (SEQ ID NO: 22) |
| 41 | AGAA + G + ARA + AAATAAAAGCATTARYAGMMATTTGTRMDGAD (SEQ ID NO: 23) |
| 41 | AGAA + GAR + A + AAATAAAAGCATTARYAGMMATTTGTRMDGAD (SEQ ID NO: 24) |
| 41 | +G + CATTARYAGMM + ATTTGTRMDGAD (SEQ ID NO: 25) |
| 41 | +GCAT + TARYAGMM + ATTTGTRMDGAD (SEQ ID NO: 26) |
| 41 | +G + CAT + TARYAGMMATTTGTRMDGAD (SEQ ID NO: 27) |
| 41 | +TAAAA + GCAT + TARYAGMMATTTGTRMDGAD (SEQ ID NO: 28) |
| 41 | +TAAAAG + CAT + TARYAGMMATTTGTRMDGAD (SEQ ID NO: 29) |
| 41 | +TAAAA + G + CATTARYAGMMATTTGTRMDGAD (SEQ ID NO: 30) |
| 41 | +AAA + TAAAAG + CATTARYAGMMATTTGTRMDGAD (SEQ ID NO: 31) |
| 41 | +AAATAAAA + G + CATTARYAGMMATTTGTRMDGAD (SEQ ID NO: 32) |
| 41 | +AAA + TAAAA + GCATTARYAGMMATTTGTRMDGAD (SEQ ID NO: 33) |
| 41 | AGAA + G + AR + AAATAAAAGCATTARYAGMMATTTGTRMDGAD (SEQ ID NO: 34) |
| 44 | CATTARYAGMMATTTGTRMDGADATGGARRARGA (SEQ ID NO: 35) |
| 44 | CATTARYAGMMATTTGTRMDGADATGGARRARG (SEQ ID NO: 36) |
| 44 | GCATTARYAGMMATTTGTRMDGADATGGARRARGA (SEQ ID NO: 37) |
| 44 | GCATTARYAGMMATTTGTRMDGADATGGARRARG (SEQ ID NO: 38) |
| 44 | TAAAAGCATTARYAGMMATTTGTRMDGADATGGARRARGA (SEQ ID NO: 39) |
| 44 | ATAAAAGCATTARYAGMMATTTGTRMDGADATGGARRARG (SEQ ID NO: 40) |
| 44 | TTTGTRMDGADATGGARRARGA (SEQ ID NO: 41) |
| 44 | TTTGTRMDGADATGGARRARG (SEQ ID NO: 42) |
| 44 | ATTTGTRMDGADATGGARRARGA (SEQ ID NO: 43) |
| 44 | ATTTGTRMDGADATGGARRARG (SEQ ID NO: 44) |
| 44 | TARYAGMMATTTGTRMDGADATGGARRARGA (SEQ ID NO: 45) |
| 44 | TARYAGMMATTTGTRMDGADATGGARRARG (SEQ ID NO: 46) |
| 44 | GARAAAATAAAAGCMTTARYAGMMATYTGTRMDGARATGGAAAAG (SEQ ID NO: 47) |
| 44 | CATTARYAGMMATTTGTRMDGADATGGARRARGA + N (SEQ ID NO: 48) |
| 44 | CATTARYAGMMATTTGTRMDGADATGGARRARG + N (SEQ ID NO: 49) |
| 44 | GCATTARYAGMMATTTGTRMDGADATGGARRARGA + N (SEQ ID NO: 50) |
| 44 | GCATTARYAGMMATTTGTRMDGADATGGARRARG + N (SEQ ID NO: 51) |
| 44 | TAAAAGCATTARYAGMMATTTGTRMDGADATGGARRARGA + N (SEQ ID NO: 52) |

TABLE 5 -continued

| | |
|---|---|
| 44 | ATAAAAGCATTARYAGMMATTTGTRMDGADATGGARRARG + N (SEQ ID NO: 53) |
| 44 | TTTGTRMDGADATGGARRARGA + N (SEQ ID NO: 54) |
| 44 | TTTGTRMDGADATGGARRARG + N (SEQ ID NO: 55) |
| 44 | ATTTGTRMDGADATGGARRARGA + N (SEQ ID NO: 56) |
| 44 | ATTTGTRMDGADATGGARRARG + N (SEQ ID NO: 57) |
| 44 | TARYAGMMATTTGTRMDGADATGGARRARGA + N (SEQ ID NO: 58) |
| 44 | TARYAGMMATTTGTRMDGADATGGARRARG + N (SEQ ID NO: 59) |
| 44 | GARAAAATAAAAGCMTTARYAGMMATYTGTRMDGARATGGAAAAG + N (SEQ ID NO: 60) |
| 44 | +CAT + TARYAGMMA + TTTGTRMDGADATGGARRARGA (SEQ ID NO: 61) |
| 44 | +CAT + TARYAGMMA + TTTGTRMDGADATGGARRARG (SEQ ID NO: 62) |
| 44 | +CATTARYAGMM + A + TTTGTRMDGADATGGARRARGA (SEQ ID NO: 63) |
| 44 | +CATTARYAGMM + A + TTTGTRMDGADATGGARRARG (SEQ ID NO: 64) |
| 44 | +CAT + TARYAGMM + ATTTGTRMDGADATGGARRARGA (SEQ ID NO: 65) |
| 44 | +CAT + TARYAGMM + ATTTGTRMDGADATGGARRARG (SEQ ID NO: 66) |
| 44 | +G + CATTARYAGMM + ATTTGTRMDGADATGGARRARGA (SEQ ID NO: 67) |
| 44 | +G + CATTARYAGMM + ATTTGTRMDGADATGGARRARG (SEQ ID NO: 68) |
| 44 | +GCAT + TARYAGMM + ATTTGTRMDGADATGGARRARGA (SEQ ID NO: 69) |
| 44 | +GCAT + TARYAGMM + ATTTGTRMDGADATGGARRARG (SEQ ID NO: 70) |
| 44 | +G + CAT + TARYAGMMATTTGTRMDGADATGGARRARGA (SEQ ID NO: 71) |
| 44 | +G + CAT + TARYAGMMATTTGTRMDGADATGGARRARG (SEQ ID NO: 72) |
| 44 | +TAAAA + GCAT + TARYAGMMATTTGTRMDGADATGGARRARGA (SEQ ID NO: 73) |
| 44 | A + TAAAA + GCAT + TARYAGMMATTTGTRMDGADATGGARRARG (SEQ ID NO: 74) |
| 44 | +TAAAAG + CAT + TARYAGMMATTTGTRMDGADATGGARRARGA (SEQ ID NO: 75) |
| 44 | A + TAAAAG + CAT + TARYAGMMATTTGTRMDGADATGGARRARG (SEQ ID NO: 76) |
| 44 | +TT + TGTRMDGADA + TGGARRARGA (SEQ ID NO: 77) |
| 44 | +TT + TGTRMDGADA + TGGARRARG (SEQ ID NO: 78) |
| 44 | +TTT + GTRMDGADA + TGGARRARGA (SEQ ID NO: 79) |
| 44 | +TTT + GTRMDGADA + TGGARRARG (SEQ ID NO: 80) |
| 44 | +TT + T + GTRMDGADATGGARRARGA (SEQ ID NO: 81) |
| 44 | +TT + T + GTRMDGADATGGARRARG (SEQ ID NO: 82) |
| 44 | +A + TTT + GTRMDGADATGGARRARGA (SEQ ID NO: 83) |
| 44 | +A + TTT + GTRMDGADATGGARRARG (SEQ ID NO: 84) |
| 44 | +ATT + T + GTRMDGADATGGARRARGA (SEQ ID NO: 85) |
| 44 | +ATT + T + GTRMDGADATGGARRARG (SEQ ID NO: 86) |
| 44 | +A + TT + TGTRMDGADATGGARRARGA (SEQ ID NO: 87) |
| 44 | +A + TT + TGTRMDGADATGGARRARG (SEQ ID NO: 88) |
| 44 | +TARYAGMM + ATT + TGTRMDGADATGGARRARGA (SEQ ID NO: 89) |
| 44 | +TARYAGMM + ATT + TGTRMDGADATGGARRARG (SEQ ID NO: 90) |
| 44 | +TARYAGMMA + TT + TGTRMDGADATGGARRARGA (SEQ ID NO: 91) |

TABLE 5 -continued

| | |
|---|---|
| 44 | +TARYAGMMA + TT + TGTRMDGADATGGARRARG (SEQ ID NO: 92) |
| 44 | +TARYAGMM + A + TTTGTRMDGADATGGARRARGA (SEQ ID NO: 93) |
| 44 | +TARYAGMM + A + TTTGTRMDGADATGGARRARG (SEQ ID NO: 94) |
| 44 | +TAAAA + G + CATTARYAGMMATTTGTRMDGADATGGARRARGA (SEQ ID NO: 95) |
| 44 | A + TAAAA + G + CATTARYAGMMATTTGTRMDGADATGGARRARG (SEQ ID NO: 96) |
| 62 | GGGCCTGAAAAYCCATAYAAYACTCCARTATTTG (SEQ ID NO: 97) |
| 62 | TTGGGCCTGAAAAYCCATAYAAYACTCCARTATTTG (SEQ ID NO: 98) |
| 62 | ARAATTGGGCCTGAAAAYCCATAYAAYACTCCARTATTTG (SEQ ID NO: 99) |
| 62 | CTGAAAAYCCATAYAAYACTCCARTATTTG (SEQ ID NO: 100) |
| 62 | CCTGAAAAYCCATAYAAYACTCCARTATTTG (SEQ ID NO: 101) |
| 62 | GGCCTGAAAAYCCATAYAAYACTCCARTATTTG (SEQ ID NO: 102) |
| 62 | ATYWCAARAATYGGGCCTGARAAYCCATAYAAYACTCCAGTATTT (SEQ ID NO: 103) |
| 62 | GGGCCTGAAAAYCCATAYAAYACTCCARTATTTG + N (SEQ ID NO: 104) |
| 62 | TTGGGCCTGAAAAYCCATAYAAYACTCCARTATTTG + N (SEQ ID NO: 105) |
| 62 | ARAATTGGGCCTGAAAAYCCATAYAAYACTCCARTATTTG + N (SEQ ID NO: 106) |
| 62 | CTGAAAAYCCATAYAAYACTCCARTATTTG + N (SEQ ID NO: 107) |
| 62 | CCTGAAAAYCCATAYAAYACTCCARTATTTG + N (SEQ ID NO: 108) |
| 62 | GGCCTGAAAAYCCATAYAAYACTCCARTATTTG + N (SEQ ID NO: 109) |
| 62 | ATYWCAARAATYGGGCCTGARAAYCCATAYAAYACTCCAGTATTT + N (SEQ ID NO: 110) |
| 62 | +G + GGC + CTGAAAAYCCATAYAAYACTCCARTATTTG (SEQ ID NO: 111) |
| 62 | +GGG + C + CTGAAAAYCCATAYAAYACTCCARTATTTG (SEQ ID NO: 112) |
| 62 | +G + GG + CCTGAAAAYCCATAYAAYACTCCARTATTTG (SEQ ID NO: 113) |
| 62 | +TT + GGG + CCTGAAAAYCCATAYAAYACTCCARTATTTG (SEQ ID NO: 114) |
| 62 | +TTG + GG + CCTGAAAAYCCATAYAAYACTCCARTATTTG (SEQ ID NO: 115) |
| 62 | +TT + G + GGCCTGAAAAYCCATAYAAYACTCCARTATTTG (SEQ ID NO: 116) |
| 62 | +ARAA + TTG + GGCCTGAAAAYCCATAYAAYACTCCARTATTTG (SEQ ID NO: 117) |
| 62 | +ARAATT + G + GGCCTGAAAAYCCATAYAAYACTCCARTATTTG (SEQ ID NO: 118) |
| 62 | +CT + GAA + AAYCCATAYAAYACTCCARTATTTG (SEQ ID NO: 119) |
| 62 | +CTG + AA + AAYCCATAYAAYACTCCARTATTTG (SEQ ID NO: 120) |
| 62 | +CT + G + AAAAYCCATAYAAYACTCCARTATTTG (SEQ ID NO: 121) |
| 62 | +C + CTG + AAAAYCCATAYAAYACTCCARTATTTG (SEQ ID NO: 122) |
| 62 | +CCT + G + AAAAYCCATAYAAYACTCCARTATTTG (SEQ ID NO: 123) |
| 62 | +C + CT + GAAAAYCCATAYAAYACTCCARTATTTG (SEQ ID NO: 124) |
| 62 | +GG + CCT + GAAAAYCCATAYAAYACTCCARTATTTG (SEQ ID NO: 125) |
| 62 | +GGC + CT + GAAAAYCCATAYAAYACTCCARTATTTG (SEQ ID NO: 126) |
| 62 | +GG + C + CTGAAAAYCCATAYAAYACTCCARTATTTG (SEQ ID NO: 127) |
| 62 | +ARAA + TT + GGGCCTGAAAAYCCATAYAAYACTCCARTATTTG (SEQ ID NO: 128) |
| 65 | GAAAAYCCATAYAAYACTCCARTATTTGCYATAAARA (SEQ ID NO: 129) |

TABLE 5 -continued

| 65 | AAAAYCCATAYAAYACTCCARTATTTGCYATAAARAA (SEQ ID NO: 130) |
| 65 | CTGAAAAYCCATAYAAYACTCCARTATTTGCYATAAARA (SEQ ID NO: 131) |
| 65 | GAAAAYCCATAYAAYACTCCARTATTTGCYATAAARAA (SEQ ID NO: 132) |
| 65 | CCTGAAAAYCCATAYAAYACTCCARTATTTGCYATAAARA (SEQ ID NO: 133) |
| 65 | CTGAAAAYCCATAYAAYACTCCARTATTTGCYATAAARAA (SEQ ID NO: 134) |
| 65 | AYCCATAYAAYACTCCARTATTTGCYATAAARA (SEQ ID NO: 135) |
| 65 | CCATAYAAYACTCCARTATTTGCYATAAARAA (SEQ ID NO: 136) |
| 65 | AAYCCATAYAAYACTCCARTATTTGCYATAAARA (SEQ ID NO: 137) |
| 65 | AYCCATAYAAYACTCCARTATTTGCYATAAARAA (SEQ ID NO: 138) |
| 65 | AAAAYCCATAYAAYACTCCARTATTTGCYATAAARA (SEQ ID NO: 139) |
| 65 | AAYCCATAYAAYACTCCARTATTTGCYATAAARAA (SEQ ID NO: 140) |
| 65 | ATYGGGCCTGARAAYCCATAYAAYACTCCARTATTTGCYATAAAG (SEQ ID NO: 141) |
| 65 | GAAAAYCCATAYAAYACTCCARTATTTGCYATAAARA + N (SEQ ID NO: 142) |
| 65 | AAAAYCCATAYAAYACTCCARTATTTGCYATAAARAA + N (SEQ ID NO: 143) |
| 65 | CTGAAAAYCCATAYAAYACTCCARTATTTGCYATAAARA + N (SEQ ID NO: 144) |
| 65 | GAAAAYCCATAYAAYACTCCARTATTTGCYATAAARAA + N (SEQ ID NO: 145) |
| 65 | CCTGAAAAYCCATAYAAYACTCCARTATTTGCYATAAARA + N (SEQ ID NO: 146) |
| 65 | CTGAAAAYCCATAYAAYACTCCARTATTTGCYATAAARAA + N (SEQ ID NO: 147) |
| 65 | AYCCATAYAAYACTCCARTATTTGCYATAAARA + N (SEQ ID NO: 148) |
| 65 | CCATAYAAYACTCCARTATTTGCYATAAARAA + N (SEQ ID NO: 149) |
| 65 | AAYCCATAYAAYACTCCARTATTTGCYATAAARA + N (SEQ ID NO: 150) |
| 65 | AYCCATAYAAYACTCCARTATTTGCYATAAARAA + N (SEQ ID NO: 151) |
| 65 | AAAAYCCATAYAAYACTCCARTATTTGCYATAAARA + N (SEQ ID NO: 152) |
| 65 | AAYCCATAYAAYACTCCARTATTTGCYATAAARAA + N (SEQ ID NO: 153) |
| 65 | ATYGGGCCTGARAAYCCATAYAAYACTCCARTATTTGCYATAAAG + N (SEQ ID NO: 154) |
| 65 | +G + AAA + AYCCATAYAAYACTCCARTATTTGCYATAAARA (SEQ ID NO: 155) |
| 65 | +AA + AAY + CCATAYAAYACTCCARTATTTGCYATAAARAA (SEQ ID NO: 156) |
| 65 | +GAA + A + AYCCATAYAAYACTCCARTATTTGCYATAAARAA (SEQ ID NO: 157) |
| 65 | +AAA + AY + CCATAYAAYACTCCARTATTTGCYATAAARAA (SEQ ID NO: 158) |
| 65 | +G + AA + AAYCCATAYAAYACTCCARTATTTGCYATAAARA (SEQ ID NO: 159) |
| 65 | +AA + A + AYCCATAYAAYACTCCARTATTTGCYATAAARAA (SEQ ID NO: 160) |
| 65 | +CT + GAA + AAYCCATAYAAYACTCCARTATTTGCYATAAARA (SEQ ID NO: 161) |
| 65 | +G + AAA + AYCCATAYAAYACTCCARTATTTGCYATAAARAA (SEQ ID NO: 162) |
| 65 | +CTG + AA + AAYCCATAYAAYACTCCARTATTTGCYATAAARA (SEQ ID NO: 163) |
| 65 | +GAA + A + AYCCATAYAAYACTCCARTATTTGCYATAAARAA (SEQ ID NO: 164) |
| 65 | +CT + G + AAAAYCCATAYAAYACTCCARTATTTGCYATAAARA (SEQ ID NO: 165) |
| 65 | +G + AA + AAYCCATAYAAYACTCCARTATTTGCYATAAARAA (SEQ ID NO: 166) |

TABLE 5 -continued

| | | |
|---|---|---|
| 65 | +C + CTG + AAAAYCCATAYAAYACTCCARTATTTGCYATAAARA | (SEQ ID NO: 167) |
| 65 | +CT + GAA + AAYCCATAYAAYACTCCARTATTTGCYATAAARAA | (SEQ ID NO: 168) |
| 65 | +CCT + G + AAAAYCCATAYAAYACTCCARTATTTGCYATAAARA | (SEQ ID NO: 169) |
| 65 | +CTG + AA + AAYCCATAYAAYACTCCARTATTTGCYATAAARAA | (SEQ ID NO: 170) |
| 65 | +AY + CCA + TAYAAYACTCCARTATTTGCYATAAARA | (SEQ ID NO: 171) |
| 65 | +C + CAT + AYAAYACTCCARTATTTGCYATAAARAA | (SEQ ID NO: 172) |
| 65 | +AYC + CA + TAYAAYACTCCARTATTTGCYATAAARA | (SEQ ID NO: 173) |
| 65 | +CCA + T + AYAAYACTCCARTATTTGCYATAAARAA | (SEQ ID NO: 174) |
| 65 | +AY + C + CATAYAAYACTCCARTATTTGCYATAAARA | (SEQ ID NO: 175) |
| 65 | +C + CA + TAYAAYACTCCARTATTTGCYATAAARAA | (SEQ ID NO: 176) |
| 65 | +A + AYC + CATAYAAYACTCCARTATTTGCYATAAARA | (SEQ ID NO: 177) |
| 65 | +AY + CCA + TAYAAYACTCCARTATTTGCYATAAARAA | (SEQ ID NO: 178) |
| 65 | +AAY + C + CATAYAAYACTCCARTATTTGCYATAAARA | (SEQ ID NO: 179) |
| 65 | +AYC + CA + TAYAAYACTCCARTATTTGCYATAAARAA | (SEQ ID NO: 180) |
| 65 | +A + AY + CCATAYAAYACTCCARTATTTGCYATAAARA | (SEQ ID NO: 181) |
| 65 | +AY + C + CATAYAAYACTCCARTATTTGCYATAAARAA | (SEQ ID NO: 182) |
| 65 | +AA + AAY + CCATAYAAYACTCCARTATTTGCYATAAARA | (SEQ ID NO: 183) |
| 65 | +A + AYC + CATAYAAYACTCCARTATTTGCYATAAARAA | (SEQ ID NO: 184) |
| 65 | +AAA + AY + CCATAYAAYACTCCARTATTTGCYATAAARA | (SEQ ID NO: 185) |
| 65 | +AAY + C + CATAYAAYACTCCARTATTTGCYATAAARAA | (SEQ ID NO: 186) |
| 65 | +AA + A + AYCCATAYAAYACTCCARTATTTGCYATAAARA | (SEQ ID NO: 187) |
| 65 | +A + AY + CCATAYAAYACTCCARTATTTGCYATAAARAA | (SEQ ID NO: 188) |
| 65 | +C + CT + GAAAAYCCATAYAAYACTCCARTATTTGCYATAAARA | (SEQ ID NO: 189) |
| 65 | +CT + G + AAAAYCCATAYAAYACTCCARTATTTGCYATAAARAA | (SEQ ID NO: 190) |
| 67 | CCATAYAAYACTCCARTATTTGCYATAAARAARAAR | (SEQ ID NO: 191) |
| 67 | CCATAYAAYACTCCARTATTTGCYATAAARAARAARG | (SEQ ID NO: 192) |
| 67 | CATAYAAYACTCCARTATTTGCYATAAARAARAARGA | (SEQ ID NO: 193) |
| 67 | AYCCATAYAAYACTCCARTATTTGCYATAAARAARAAR | (SEQ ID NO: 194) |
| 67 | AYCCATAYAAYACTCCARTATTTGCYATAAARAARAARG | (SEQ ID NO: 195) |
| 67 | CCATAYAAYACTCCARTATTTGCYATAAARAARAARGA | (SEQ ID NO: 196) |
| 67 | AAAYCCATAYAAYACTCCARTATTTGCYATAAARAARAAR | (SEQ ID NO: 197) |
| 67 | AAYCCATAYAAYACTCCARTATTTGCYATAAARAARAARG | (SEQ ID NO: 198) |
| 67 | AYCCATAYAAYACTCCARTATTTGCYATAAARAARAARGA | (SEQ ID NO: 199) |
| 67 | AYAAYACTCCARTATTTGCYATAAARAARAARAAR | (SEQ ID NO: 200) |
| 67 | AYAAYACTCCARTATTTGCYATAAARAARAARAARG | (SEQ ID NO: 201) |
| 67 | AAYACTCCARTATTTGCYATAAARAARAARAARGA | (SEQ ID NO: 202) |

TABLE 5-continued

| 67 | TAYAAYACTCCARTATTTGCYATAAARAARAAR (SEQ ID NO: 203) |
| --- | --- |
| 67 | TAYAAYACTCCARTATTTGCYATAAARAARAARG (SEQ ID NO: 204) |
| 67 | AYAAYACTCCARTATTTGCYATAAARAARAARGA (SEQ ID NO: 205) |
| 67 | CATAYAAYACTCCARTATTTGCYATAAARAARAAR (SEQ ID NO: 206) |
| 67 | CATAYAAYACTCCARTATTTGCYATAAARAARAARG (SEQ ID NO: 207) |
| 67 | TAYAAYACTCCARTATTTGCYATAAARAARAARGA (SEQ ID NO: 208) |
| 67 | CCTGARAAYCCATAYAAYACTCCARTATTTGCYATAAAGAAAAAA (SEQ ID NO: 209) |
| 67 | CCATAYAAYACTCCARTATTTGCYATAAARAARAAR + N (SEQ ID NO: 210) |
| 67 | CCATAYAAYACTCCARTATTTGCYATAAARAARAARG + N (SEQ ID NO: 211) |
| 67 | CATAYAAYACTCCARTATTTGCYATAAARAARAARGA + N (SEQ ID NO: 212) |
| 67 | AYCCATAYAAYACTCCARTATTTGCYATAAARAARAAR + N (SEQ ID NO: 213) |
| 67 | AYCCATAYAAYACTCCARTATTTGCYATAAARAARAARG + N (SEQ ID NO: 214) |
| 67 | CCATAYAAYACTCCARTATTTGCYATAAARAARAARGA + N (SEQ ID NO: 215) |
| 67 | AAAYCCATAYAAYACTCCARTATTTGCYATAAARAARAAR + N (SEQ ID NO: 216) |
| 67 | AAYCCATAYAAYACTCCARTATTTGCYATAAARAARAARG + N (SEQ ID NO: 217) |
| 67 | AYCCATAYAAYACTCCARTATTTGCYATAAARAARAARGA + N (SEQ ID NO: 218) |
| 67 | AYAAYACTCCARTATTTGCYATAAARAARAAR + N (SEQ ID NO: 219) |
| 67 | AYAAYACTCCARTATTTGCYATAAARAARAARG + N (SEQ ID NO: 220) |
| 67 | AAYACTCCARTATTTGCYATAAARAARAARGA + N (SEQ ID NO: 221) |
| 67 | TAYAAYACTCCARTATTTGCYATAAARAARAAR + N (SEQ ID NO: 222) |
| 67 | TAYAAYACTCCARTATTTGCYATAAARAARAARG + N (SEQ ID NO: 223) |
| 67 | AYAAYACTCCARTATTTGCYATAAARAARAARGA + N (SEQ ID NO: 224) |
| 67 | CATAYAAYACTCCARTATTTGCYATAAARAARAAR + N (SEQ ID NO:225) |
| 67 | CATAYAAYACTCCARTATTTGCYATAAARAARAARG + N (SEQ ID NO: 226) |
| 67 | TAYAAYACTCCARTATTTGCYATAAARAARAARGA + N (SEQ ID NO: 227) |
| 67 | CCTGARAAYCCATAYAAYACTCCARTATTTGCYATAAAGAAAAAA + N (SEQ ID NO: 228) |
| 67 | +C + CAT + AYAAYACTCCARTATTTGCYATAAARAARAAR (SEQ ID NO: 229) |
| 67 | +C + CAT + AYAAYACTCCARTATTTGCYATAAARAARAARG (SEQ ID NO: 230) |
| 67 | +CA + TAY + AAYACTCCARTATTTGCYATAAARAARAARGA (SEQ ID NO: 231) |
| 67 | +CCA + T + AYAAYACTCCARTATTTGCYATAAARAARAAR (SEQ ID NO: 232) |
| 67 | +CCA + T + AYAAYACTCCARTATTTGCYATAAARAARAARG (SEQ ID NO: 233) |
| 67 | +CAT + AY + AAYACTCCARTATTTGCYATAAARAARAARGA (SEQ ID NO: 234) |
| 67 | +C + CA + TAYAAYACTCCARTATTTGCYATAAARAARAAR (SEQ ID NO: 235) |
| 67 | +C + CA + TAYAAYACTCCARTATTTGCYATAAARAARAARG (SEQ ID NO: 236) |
| 67 | +CA + T + AYAAYACTCCARTATTTGCYATAAARAARAARGA (SEQ ID NO: 237) |
| 67 | +AY + CCA + TAYAAYACTCCARTATTTGCYATAAARAARAAR (SEQ ID NO: 238) |
| 67 | +AY + CCA + TAYAAYACTCCARTATTTGCYATAAARAARAARG (SEQ ID NO: 239) |
| 67 | +C + CAT + AYAAYACTCCARTATTTGCYATAAARAARAARGA (SEQ ID NO: 240) |

TABLE 5 -continued

| | |
|---|---|
| 67 | +AYC + CA + TAYAAYACTCCARTATTTGCYATAAARAARAAR (SEQ ID NO: 241) |
| 67 | +AYC + CA + TAYAAYACTCCARTATTTGCYATAAARAARAARG (SEQ ID NO: 242) |
| 67 | +CCA + T + AYAAYACTCCARTATTTGCYATAAARAARAARGA (SEQ ID NO: 243) |
| 67 | +AY + C + CATAYAAYACTCCARTATTTGCYATAAARAARAAR (SEQ ID NO: 244) |
| 67 | +AY + C + CATAYAAYACTCCARTATTTGCYATAAARAARAARG (SEQ ID NO: 245) |
| 67 | +C + CA + TAYAAYACTCCARTATTTGCYATAAARAARAARGA (SEQ ID NO: 246) |
| 67 | A + A + AYC + CATAYAAYACTCCARTATTTGCYATAAARAARAAR (SEQ ID NO: 247) |
| 67 | +A + AYC + CATAYAAYACTCCARTATTTGCYATAAARAARAARG (SEQ ID NO: 248) |
| 67 | +AY + CCA + TAYAAYACTCCARTATTTGCYATAAARAARAARGA (SEQ ID NO: 249) |
| 67 | A + AAY + C + CATAYAAYACTCCARTATTTGCYATAAARAARAAR (SEQ ID NO: 250) |
| 67 | +AAY + C + CATAYAAYACTCCARTATTTGCYATAAARAARAARG (SEQ ID NO: 251) |
| 67 | +AYC + CA + TAYAAYACTCCARTATTTGCYATAAARAARAARGA (SEQ ID NO: 252) |
| 67 | +AY + AAY + ACTCCARTATTTGCYATAAARAARAAR (SEQ ID NO: 253) |
| 67 | +AY + AAY + ACTCCARTATTTGCYATAAARAARAARG (SEQ ID NO: 254) |
| 67 | +A + AYA + CTCCARTATTTGCYATAAARAARAARGA (SEQ ID NO: 255) |
| 67 | +AYA + AY + ACTCCARTATTTGCYATAAARAARAAR (SEQ ID NO: 256) |
| 67 | +AYA + AY + ACTCCARTATTTGCYATAAARAARAARG (SEQ ID NO: 257) |
| 67 | +AAY + A + CTCCARTATTTGCYATAAARAARAARGA (SEQ ID NO: 258) |
| 67 | +AY + A + AYACTCCARTATTTGCYATAAARAARAAR (SEQ ID NO: 259) |
| 67 | +AY + A + AYACTCCARTATTTGCYATAAARAARAARG (SEQ ID NO: 260) |
| 67 | +A + AY + ACTCCARTATTTGCYATAAARAARAARGA (SEQ ID NO: 261) |
| 67 | +T + AYA + AYACTCCARTATTTGCYATAAARAARAAR (SEQ ID NO: 262) |
| 67 | +T + AYA + AYACTCCARTATTTGCYATAAARAARAARG (SEQ ID NO: 263) |
| 67 | +AY + AAY + ACTCCARTATTTGCYATAAARAARAARGA (SEQ ID NO: 264) |
| 67 | +TAY + A + AYACTCCARTATTTGCYATAAARAARAAR (SEQ ID NO: 265) |
| 67 | +TAY + A + AYACTCCARTATTTGCYATAAARAARAARG (SEQ ID NO: 266) |
| 67 | +AYA + AY + ACTCCARTATTTGCYATAAARAARAARGA (SEQ ID NO: 267) |
| 67 | +T + AY + AAYACTCCARTATTTGCYATAAARAARAAR (SEQ ID NO: 268) |
| 67 | +T + AY + AAYACTCCARTATTTGCYATAAARAARAARG (SEQ ID NO: 269) |
| 67 | +AY + A + AYACTCCARTATTTGCYATAAARAARAARGA (SEQ ID NO: 270) |
| 67 | +CA + TAY + AAYACTCCARTATTTGCYATAAARAARAAR (SEQ ID NO: 271) |
| 67 | +CA + TAY + AAYACTCCARTATTTGCYATAAARAARAARG (SEQ ID NO: 272) |
| 67 | +T + AYA + AYACTCCARTATTTGCYATAAARAARAARGA (SEQ ID NO: 273) |
| 67 | +CAT + AY + AAYACTCCARTATTTGCYATAAARAARAAR (SEQ ID NO: 274) |
| 67 | +CAT + AY + AAYACTCCARTATTTGCYATAAARAARAARG (SEQ ID NO: 275) |
| 67 | +TAR + A + AYACTCCARTATTTGCYATAAARAARAARGA (SEQ ID NO: 276) |

TABLE 5 -continued

| | |
|---|---|
| 67 | +CA + T + AYAAYACTCCARTATTTGCYATAAARAARAAR (SEQ ID NO: 277) |
| 67 | +CA + T + AYAAYACTCCARTATTTGCYATAAARAARAARG (SEQ ID NO: 278) |
| 67 | +T + AY + AAYACTCCARTATTTGCYATAAARAARAARGA (SEQ ID NO: 279) |
| 67 | A + A + AY + CCATAYAAYACTCCARTATTTGCYATAAARAARAAR (SEQ ID NO: 280) |
| 67 | +A + AY + CCATAYAAYACTCCARTATTTGCYATAAARAARAARG (SEQ ID NO: 281) |
| 67 | +AY + C + CATAYAAYACTCCARTATTTGCYATAAARAARAARGA (SEQ ID NO: 282) |
| 69 | AAYCCATAYAAYACTCCARTATTTGCYATAAARAARAARGACAGT (SEQ ID NO: 283) |
| 69 | AAYCCATAYAAYACTCCARTATTTGCYATAAARAARAARGACAGT + N (SEQ ID NO: 284) |
| 70 | ACTCCARTATTTGCYATAAARAARAARGAYAGYACY (SEQ ID NO: 285) |
| 70 | ACTCCARTATTTGCYATAAARAARAARGAYAGYACYA (SEQ ID NO: 286) |
| 70 | AYACTCCARTATTTGCYATAAARAARAARGAYAGYACY (SEQ ID NO: 287) |
| 70 | AYACTCCARTATTTGCYATAAARAARAARGAYAGYACYA (SEQ ID NO: 288) |
| 70 | YAAYACTCCARTATTTGCYATAAARAARAARGAYAGYACY (SEQ ID NO: 289) |
| 70 | AAYACTCCARTATTTGCYATAAARAARAARGAYAGYACYA (SEQ ID NO: 290) |
| 70 | CARTATTTGCYATAAARAARAARGAYAGYACY (SEQ ID NO: 291) |
| 70 | CARTATTTGCYATAAARAARAARGAYAGYACYA (SEQ ID NO: 292) |
| 70 | CCARTATTTGCYATAAARAARAARGAYAGYACY (SEQ ID NO: 293) |
| 70 | CCARTATTTGCYATAAARAARAARGAYAGYACYA (SEQ ID NO: 294) |
| 70 | CTCCARTATTTGCYATAAARAARAARGAYAGYACY (SEQ ID NO: 295) |
| 70 | CTCCARTATTTGCYATAAARAARAARGAYAGYACYA (SEQ ID NO: 296) |
| 70 | CCATAYAAYACTCCARTATTTGCYATAAARAARAARGACAGTACT (SEQ ID NO: 297) |
| 70 | ACTCCARTATTTGCYATAAARAARAARGAYAGYACY + N (SEQ ID NO: 298) |
| 70 | ACTCCARTATTTGCYATAAARAARAARGAYAGYACYA + N (SEQ ID NO: 299) |
| 70 | AYACTCCARTATTTGCYATAAARAARAARGAYAGYACY + N (SEQ ID NO: 300) |
| 70 | AYACTCCARTATTTGCYATAAARAARAARGAYAGYACYA + N (SEQ ID NO: 301) |
| 70 | YAAYACTCCARTATTTGCYATAAARAARAARGAYAGYACY + N (SEQ ID NO: 302) |
| 70 | AAYACTCCARTATTTGCYATAAARAARAARGAYAGYACYA + N (SEQ ID NO: 303) |
| 70 | CARTATTTGCYATAAARAARAARGAYAGYACY + N (SEQ ID NO: 304) |
| 70 | CARTATTTGCYATAAARAARAARGAYAGYACYA + N (SEQ ID NO: 305) |
| 70 | CCARTATTTGCYATAAARAARAARGAYAGYACY + N (SEQ ID NO: 306) |
| 70 | CCARTATTTGCYATAAARAARAARGAYAGYACYA + N (SEQ ID NO: 307) |
| 70 | CTCCARTATTTGCYATAAARAARAARGAYAGYACY + N (SEQ ID NO: 308) |
| 70 | CTCCARTATTTGCYATAAARAARAARGAYAGYACYA + N (SEQ ID NO: 309) |
| 70 | CCATAYAAYACTCCARTATTTGCYATAAARAARAARGACAGTACT + N (SEQ ID NO: 310) |
| 70 | +A + CTC + CARTATTTGCYATAAARAARAARGAYAGYACY (SEQ ID NO: 311) |

TABLE 5 -continued

| | | |
|---|---|---|
| 70 | +A + CTC + CARTATTTGCYATAAARAARAARGAYAGYACYA | (SEQ ID NO: 312) |
| 70 | +ACT + C + CARTATTTGCYATAAARAARAARGAYAGYACY | (SEQ ID NO: 313) |
| 70 | +ACT + C + CARTATTTGCYATAAARAARAARGAYAGYACYA | (SEQ ID NO: 314) |
| 70 | +A + CT + CCARTATTTGCYATAAARAARAARGAYAGYACY | (SEQ ID NO: 315) |
| 70 | +A + CT + CCARTATTTGCYATAAARAARAARGAYAGYACYA | (SEQ ID NO: 316) |
| 70 | +AY + ACT + CCARTATTTGCYATAAARAARAARGAYAGYACY | (SEQ ID NO: 317) |
| 70 | +AY + ACT + CCARTATTTGCYATAAARAARAARGAYAGYACYA | (SEQ ID NO: 318) |
| 70 | +AYA + CT + CCARTATTTGCYATAAARAARAARGAYAGYACY | (SEQ ID NO: 319) |
| 70 | +AYA + CT + CCARTATTTGCYATAAARAARAARGAYAGYACYA | (SEQ ID NO: 320) |
| 70 | +AY + A + CTCCARTATTTGCYATAAARAARAARGAYAGYACY | (SEQ ID NO: 321) |
| 70 | +AY + A + CTCCARTATTTGCYATAAARAARAARGAYAGYACYA | (SEQ ID NO: 322) |
| 70 | Y + A + AYA + CTCCARTATTTGCYATAAARAARAARGAYAGYACY | (SEQ ID NO: 323) |
| 70 | +A + AYA + CTCCARTATTTGCYATAAARAARAARGAYAGYACYA | (SEQ ID NO: 324) |
| 70 | Y+AAY + A + CTCCARTATTTGCYATAAARAARAARGAYAGYACY | (SEQ ID NO: 325) |
| 70 | +AAY + A + CTCCARTATTTGCYATAAARAARAARGAYAGYACYA | (SEQ ID NO: 326) |
| 70 | +CAR + TAT + TTGCYATAAARAARAARGAYAGYACY | (SEQ ID NO: 327) |
| 70 | +CAR + TAT + TTGCYATAAARAARAARGAYAGYACYA | (SEQ ID NO: 328) |
| 70 | +CARTA + T + TTGCYATAAARAARAARGAYAGYACY | (SEQ ID NO: 329) |
| 70 | +CARTA + T + TTGCYATAAARAARAARGAYAGYACYA | (SEQ ID NO: 330) |
| 70 | +CAR + TA + TTTGCYATAAARAARAARGAYAGYACY | (SEQ ID NO: 331) |
| 70 | +CAR + TA + TTTGCYATAAARAARAARGAYAGYACYA | (SEQ ID NO: 332) |
| 70 | +C + CARTA + TTTGCYATAAARAARAARGAYAGYACY | (SEQ ID NO: 333) |
| 70 | +C + CARTA + TTTGCYATAAARAARAARGAYAGYACYA | (SEQ ID NO: 334) |
| 70 | +CCAR + TA + TTTGCYATAAARAARAARGAYAGYACY | (SEQ ID NO: 335) |
| 70 | +CCAR + TA + TTTGCYATAAARAARAARGAYAGYACYA | (SEQ ID NO: 336) |
| 70 | +C + CAR + TATTTGCYATAAARAARAARGAYAGYACY | (SEQ ID NO: 337) |
| 70 | +C + CAR + TATTTGCYATAAARAARAARGAYAGYACYA | (SEQ ID NO: 338) |
| 70 | +CT + CCAR + TATTTGCYATAAARAARAARGAYAGYACY | (SEQ ID NO: 339) |
| 70 | +CT + CCAR + TATTTGCYATAAARAARAARGAYAGYACYA | (SEQ ID NO: 340) |
| 70 | +CTC + CAR + TATTTGCYATAAARAARAARGAYAGYACY | (SEQ ID NO: 341) |
| 70 | +CTC + CAR + TATTTGCYATAAARAARAARGAYAGYACYA | (SEQ ID NO: 342) |
| 70 | +CT + C + CARTATTTGCYATAAARAARAARGAYAGYACY | (SEQ ID NO: 343) |
| 70 | +CT + C + CARTATTTGCYATAAARAARAARGAYAGYACYA | (SEQ ID NO: 344) |
| 70 | Y + A + AY + ACTCCARTATTTGCYATAAARAARAARGAYAGYACY | (SEQ ID NO: 345) |

TABLE 5 -continued

| | | |
|---|---|---|
| 70 | +A + AY + ACTCCARTATTTGCYATAAARAARAARGAYAGYACYA (SEQ ID NO: 346) | |
| 74 | GCYATAAARAARAARGAYAGYACYAARTGGAGRAAA (SEQ ID NO: 347) | |
| 74 | TTGCYATAAARAARAARGAYAGYACYAARTGGAGRAAA (SEQ ID NO: 348) | |
| 74 | ATTTGCYATAAARAARAARGAYAGYACYAARTGGAGRAAA (SEQ ID NO: 349) | |
| 74 | AARAARAARGAYAGYACYAARTGGAGRAAA (SEQ ID NO: 350) | |
| 74 | TAAARAARAARGAYAGYACYAARTGGAGRAAA (SEQ ID NO: 351) | |
| 74 | ATAAARAARAARGAYAGYACYAARTGGAGRAAA (SEQ ID NO: 352) | |
| 74 | CCARTATTTGCYATAAARAARAARGAYAGYACYAARTGGAGAAAA (SEQ ID NO: 353) | |
| 74 | GCYATAAARAARAARGAYAGYACYAARTGGAGRAAA + N (SEQ ID NO: 354) | |
| 74 | TTGCYATAAARAARAARGAYAGYACYAARTGGAGRAAA + N (SEQ ID NO: 355) | |
| 74 | ATTTGCYATAAARAARAARGAYAGYACYAARTGGAGRAAA + N (SEQ ID NO: 356) | |
| 74 | AARAARAARGAYAGYACYAARTGGAGRAAA + N (SEQ ID NO: 357) | |
| 74 | TAAARAARAARGAYAGYACYAARTGGAGRAAA + N (SEQ ID NO: 358) | |
| 74 | ATAAARAARAARGAYAGYACYAARTGGAGRAAA + N (SEQ ID NO: 359) | |
| 74 | CCARTATTTGCYATAAARAARAARGAYAGYACYAARTGGAGAAAA + N (SEQ ID NO: 360) | |
| 74 | +GCY + ATA + AARAARAARGAYAGYACYAARTGGAGRAAA (SEQ ID NO: 361) | |
| 74 | +GCYA + TA + AARAARAARGAYAGYACYAARTGGAGRAAA (SEQ ID NO: 362) | |
| 74 | +GCY + A + TAAARAARAARGAYAGYACYAARTGGAGRAAA (SEQ ID NO: 363) | |
| 74 | +TT + GCYA + TAAARAARAARGAYAGYACYAARTGGAGRAAA (SEQ ID NO: 364) | |
| 74 | +TTGCY + A + TAAARAARAARGAYAGYACYAARTGGAGRAAA (SEQ ID NO: 365) | |
| 74 | +TT + GCY + ATAAARAARAARGAYAGYACYAARTGGAGRAAA (SEQ ID NO: 366) | |
| 74 | A + T + TTGCY + ATAAARAARAARGAYAGYACYAARTGGAGRAAA (SEQ ID NO: 367) | |
| 74 | A + TTT + GCY + ATAAARAARAARGAYAGYACYAARTGGAGRAAA (SEQ ID NO: 368) | |
| 74 | +AAR + AARA + ARGAYAGYACYAARTGGAGRAAA (SEQ ID NO: 369) | |
| 74 | +AARAAR + A + ARGAYAGYACYAARTGGAGRAAA (SEQ ID NO: 370) | |
| 74 | +AAR + AAR + AARGAYAGYACYAARTGGAGRAAA (SEQ ID NO: 371) | |
| 74 | +TA + AARAAR + AARGAYAGYACYAARTGGAGRAAA (SEQ ID NO: 372) | |
| 74 | +TAAAR + AAR + AARGAYAGYACYAARTGGAGRAAA (SEQ ID NO: 373) | |
| 74 | +TA + AAR + AARAARGAYAGYACYAARTGGAGRAAA (SEQ ID NO: 374) | |
| 74 | +A + TAAAR + AARAARGAYAGYACYAARTGGAGRAAA (SEQ ID NO: 375) | |
| 74 | +ATA + AAR + AARAARGAYAGYACYAARTGGAGRAAA (SEQ ID NO: 376) | |
| 74 | +A + TA + AARAARAARGAYAGYACYAARTGGAGRAAA (SEQ ID NO: 377) | |
| 74 | A + T + TT + GCYATAAARAARAARGAYAGYACYAARTGGAGRAAA (SEQ ID NO: 378) | |
| 75 | TAAARAARAARGAYAGYACYAARTGGAGRAAATTA (SEQ ID NO: 379) | |
| 75 | TAAARAARAARGAYAGYACYAARTGGAGRAAATTAG (SEQ ID NO: 380) | |
| 75 | ATAAARAARAARGAYAGYACYAARTGGAGRAAATTA (SEQ ID NO: 381) | |
| 75 | ATAAARAARAARGAYAGYACYAARTGGAGRAAATTAG (SEQ ID NO: 382) | |

TABLE 5 -continued

| 75 | TGCYATAAARAARAARGAYAGYACYAARTGGAGRAAATTA (SEQ ID NO: 383) |
| --- | --- |
| 75 | GCYATAAARAARAARGAYAGYACYAARTGGAGRAAATTAG (SEQ ID NO: 384) |
| 75 | AARGAYAGYACYAARTGGAGRAAATTA (SEQ ID NO: 385) |
| 75 | AARGAYAGYACYAARTGGAGRAAATTAG (SEQ ID NO: 386) |
| 75 | AARAARGAYAGYACYAART GGAGRAAATTA (SEQ ID NO: 387) |
| 75 | AARAARGAYAGYACYAART GGAGRAAATTAG (SEQ ID NO: 388) |
| 75 | AARAARAARGAYAGYACYAARTGGAGRAAATTA (SEQ ID NO: 389) |
| 75 | AARAARAARGAYAGYACYAARTGGAGRAAATTAG (SEQ ID NO: 390) |
| 75 | RTATTTGCYATAAARAARAARGAYAGYACYAARTGGAGRAAATTA (SEQ ID NO: 391) |
| 75 | TAAARAARAARGAYAGYACYAARTGGAGRAAATTA + N (SEQ ID NO: 392) |
| 75 | TAAARAARAARGAYAGYACYAARTGGAGRAAATTAG + N (SEQ ID NO: 393) |
| 75 | ATAAARAARAARGAYAGYACYAARTGGAGRAAATTA + N (SEQ ID NO: 394) |
| 75 | ATAAARAARAARGAYAGYACYAARTGGAGRAAATTAG + N (SEQ ID NO: 395) |
| 75 | TGCYATAAARAARAARGAYAGYACYAARTGGAGRAAATTA + N (SEQ ID NO: 396) |
| 75 | GCYATAAARAARAARGAYAGYACYAARTGGAGRAAATTAG + N (SEQ ID NO: 397) |
| 75 | AARGAYAGYACYAARTGGAGRAAATTA + N (SEQ ID NO: 398) |
| 75 | AARGAYAGYACYAARTGGAGRAAATTAG + N (SEQ ID NO: 399) |
| 75 | AARAARGAYAGYACYAARTGGAGRAAATTA + N (SEQ ID NO: 400) |
| 75 | AARAARGAYAGYACYAARTGGAGRAAATTAG + N (SEQ ID NO: 401) |
| 75 | AARAARAARGAYAGYACYAARTGGAGRAAATTA + N (SEQ ID NO: 402) |
| 75 | AARAARAARGAYAGYACYAARTGGAGRAAATTAG + N (SEQ ID NO: 403) |
| 75 | RTATTTGCYATAAARAARAARGAYAGYACYAARTGGAGRAAATTA + N (SEQ ID NO: 404) |
| 75 | +TA + AARAAR + AARGAYAGYACYAARTGGAGRAAATTA (SEQ ID NO: 405) |
| 75 | +TA + AARAAR + AARGAYAGYACYAARTGGAGRAAATTAG (SEQ ID NO: 406) |
| 75 | +TAAAR + AAR + AARGAYAGYACYAARTGGAGRAAATTA (SEQ ID NO: 407) |
| 75 | +TAAAR + AAR + AARGAYAGYACYAARTGGAGRAAATTAG (SEQ ID NO: 408) |
| 75 | +TA + AAR + AARAARGAYAGYACYAARTGGAGRAAATTA (SEQ ID NO: 409) |
| 75 | +TA + AAR + AARAARGAYAGYACYAARTGGAGRAAATTAG (SEQ ID NO: 410) |
| 75 | +A + TAAAR + AARAARGAYAGYACYAARTGGAGRAAATTA (SEQ ID NO: 411) |
| 75 | +A + TAAAR + AARAARGAYAGYACYAARTGGAGRAAATTAG (SEQ ID NO: 412) |
| 75 | +ATA + AAR + AARAARGAYAGYACYAARTGGAGRAAATTA (SEQ ID NO: 413) |
| 75 | +ATA + AAR + AARAARGAYAGYACYAARTGGAGRAAATTAG (SEQ ID NO: 414) |
| 75 | +A + TA + AARAARAARGAYAGYACYAARTGGAGRAAATTA (SEQ ID NO: 415) |
| 75 | +A + TA + AARAARAARGAYAGYACYAARTGGAGRAAATTAG (SEQ ID NO: 416) |
| 75 | T + GCY + ATA + AARAARAARGAYAGYACYAARTGGAGRAAATTA (SEQ ID NO: 417) |
| 75 | +GCY + ATA + AARAARAARGAYAGYACYAARTGGAGRAAATTAG (SEQ ID NO: 418) |

TABLE 5 -continued

| 75 | T + GCYA + TA + AARAARAARGAYAGYACYAARTGGAGRAAATTA (SEQ ID NO: 419) |
| 75 | +GCYA + TA + AARAARAARGAYAGYACYAARTGGAGRAAATTAG (SEQ ID NO: 420) |
| 75 | +A + ARGAYAGYACYAAR + TGGAGRAAATTA (SEQ ID NO: 421) |
| 75 | +A + ARGAYAGYACYAAR + TGGAGRAAATTAG (SEQ ID NO: 422) |
| 75 | +AARGAYAGYACY + AAR + TGGAGRAAATTA (SEQ ID NO: 423) |
| 75 | +AARGAYAGYACY + AAR + TGGAGRAAATTAG (SEQ ID NO: 424) |
| 75 | +A + ARGAYAGYACY + AARTGGAGRAAATTA (SEQ ID NO: 425) |
| 75 | +A + ARGAYAGYACY + AARTGGAGRAAATTAG (SEQ ID NO: 426) |
| 75 | +AAR + AARGAYAGYACY + AARTGGAGRAAATTA (SEQ ID NO: 427) |
| 75 | +AAR + AARGAYAGYACY + AARTGGAGRAAATTAG (SEQ ID NO: 428) |
| 75 | +AARA + ARGAYAGYACY + AARTGGAGRAAATTA (SEQ ID NO: 429) |
| 75 | +AARA + ARGAYAGYACY + AARTGGAGRAAATTAG (SEQ ID NO: 430) |
| 75 | +AAR + A + ARGAYAGYACYAARTGGAGRAAATTA (SEQ ID NO: 431) |
| 75 | +AAR + A + ARGAYAGYACYAARTGGAGRAAATTAG (SEQ ID NO: 432) |
| 75 | +AAR + AARA + ARGAYAGYACYAARTGGAGRAAATTA (SEQ ID NO: 433) |
| 75 | +AAR + AARA + ARGAYAGYACYAARTGGAGRAAATTAG (SEQ ID NO: 434) |
| 75 | +AARAAR + A + ARGAYAGYACYAARTGGAGRAAATTA (SEQ ID NO:435) |
| 75 | +AARAAR + A + ARGAYAGYACYAARTGGAGRAAATTAG (SEQ ID NO: 436) |
| 75 | +AAR + AAR + AARGAYAGYACYAARTGGAGRAAATTA (SEQ ID NO: 437) |
| 75 | +AAR + AAR + AARGAYAGYACYAARTGGAGRAAATTAG (SEQ ID NO: 438) |
| 75 | T + GCY + A + TAAARAARAARGAYAGYACYAARTGGAGRAAATTA (SEQ ID NO: 439) |
| 75 | +GCY + A + TAAARAARAARGAYAGYACYAARTGGAGRAAATTAG (SEQ ID NO: 440) |
| 77 | ARGAYAGYACYAARTGGAGRAAATTAGTAGAYTT (SEQ ID NO: 441) |
| 77 | AARGAYAGYACYAARTGGAGRAAATTAGTAGAYTT (SEQ ID NO: 442) |
| 77 | ARAARAARGAYAGYACYAARTGGAGRAAATTAGTAGAYTT (SEQ ID NO: 443) |
| 77 | AARTGGAGRAAATTAGTAGAYTT (SEQ ID NO: 444) |
| 77 | GCYATAAARAARAARGAYAGYACYAARTGGAGRAAATTAGTAGAT (SEQ ID NO: 445) |
| 77 | ARGAYAGYACYAARTGGAGRAAATTAGTAGAYTT + N (SEQ ID NO: 446) |
| 77 | AARGAYAGYACYAARTGGAGRAAATTAGTAGAYTT + N (SEQ ID NO: 447) |
| 77 | ARAARAARGAYAGYACYAARTGGAGRAAATTAGTAGAYTT + N (SEQ ID NO: 448) |
| 77 | AARTGGAGRAAATTAGTAGAYTT + N (SEQ ID NO: 449) |
| 77 | GCYATAAARAARAARGAYAGYACYAARTGGAGRAAATTAGTAGAT + N (SEQ ID NO: 450) |
| 77 | +ARGAYAGYACY + AART + GGAGRAAATTAGTAGAYTT (SEQ ID NO: 451) |
| 77 | +ARGAYAGYACYAAR + T + GGAGRAAATTAGTAGAYTT (SEQ ID NO: 452) |
| 77 | +ARGAYAGYACY + AAR + TGGAGRAAATTAGTAGAYTT (SEQ ID NO: 453) |
| 77 | +A + ARGAYAGYACYAAR + TGGAGRAAATTAGTAGAYTT (SEQ ID NO: 454) |
| 77 | +AARGAYAGYACY + AAR + TGGAGRAAATTAGTAGAYTT (SEQ ID NO: 455) |

TABLE 5 -continued

| | |
|---|---|
| 77 | +A + ARGAYAGYACY + AARTGGAGRAAATTAGTAGAYTT (SEQ ID NO: 456) |
| 77 | AR + AAR + AARGAYAGYACY + AARTGGAGRAAATTAGTAGAYTT (SEQ ID NO: 457) |
| 77 | AR + AARA + ARGAYAGYACY + AARTGGAGRAAATTAGTAGAYTT (SEQ ID NO: 458) |
| 77 | +AAR + TG + GAGRAAATTAGTAGAYTT (SEQ ID NO: 459) |
| 77 | +AART + G + GAGRAAATTAGTAGAYTT (SEQ ID NO: 460) |
| 77 | +AAR + T + GGAGRAAATTAGTAGAYTT (SEQ ID NO: 461) |
| 77 | AR + AAR + A + ARGAYAGYACYAARTGGAGRAAATTAGTAGAYTT (SEQ ID NO: 462) |
| 90 | GARCTYAATAARAGAACTCARGAYTTYTGGGAR (SEQ ID NO: 463) |
| 90 | GRGARCTYAATAARAGAACTCARGAYTTYTGGGAR (SEQ ID NO: 464) |
| 90 | YTTYAGRGARCTYAATAARAGAACTCARGAYTTYTGGGAR (SEQ ID NO: 465) |
| 90 | TYAATAARAGAACTCARGAYTTYTGGGAR (SEQ ID NO: 466) |
| 90 | CTYAATAARAGAACTCARGAYTTYTGGGAR (SEQ ID NO: 467) |
| 90 | ARCTYAATAARAGAACTCARGAYTTYTGGGAR (SEQ ID NO: 468) |
| 90 | GTRGAYTTYAGRGARCTYAATAARARAACTCARGAYTTCTGGGAA (SEQ ID NO: 469) |
| 90 | GARCTYAATAARAGAACTCARGAYTTYTGGGAR + N (SEQ ID NO: 470) |
| 90 | GRGARCTYAATAARAGAACTCARGAYTTYTGGGAR + N (SEQ ID NO: 471) |
| 90 | YTTYAGRGARCTYAATAARAGAACTCARGAYTTYTGGGAR + N (SEQ ID NO: 472) |
| 90 | TYAATAARAGAACTCARGAYTTYTGGGAR + N (SEQ ID NO: 473) |
| 90 | CTYAATAARAGAACTCARGAYTTYTGGGAR + N (SEQ ID NO: 474) |
| 90 | ARCTYAATAARAGAACTCARGAYTTYTGGGAR + N (SEQ ID NO: 475) |
| 90 | GTRGAYTTYAGRGARCTYAATAARARAACTCARGAYTTCTGGGAA + N (SEQ ID NO: 476) |
| 90 | +G + ARC + TYAATAARAGAACTCARGAYTTYTGGGAR (SEQ ID NO: 477) |
| 90 | +GAR + C + TYAATAARAGAACTCARGAYTTYTGGGAR (SEQ ID NO: 478) |
| 90 | +G + AR + CTYAATAARAGAACTCARGAYTTYTGGGAR (SEQ ID NO: 479) |
| 90 | +GR + GAR + CTYAATAARAGAACTCARGAYTTYTGGGAR (SEQ ID NO: 480) |
| 90 | +GRG + AR + CTYAATAARAGAACTCARGAYTTYTGGGAR (SEQ ID NO: 481) |
| 90 | +GR + G + ARCTYAATAARAGAACTCARGAYTTYTGGGAR (SEQ ID NO: 482) |
| 90 | YT + TYA + GRG + ARCTYAATAARAGAACTCARGAYTTYTGGGAR (SEQ ID NO: 483) |
| 90 | YT + TYAGR + G + ARCTYAATAARAGAACTCARGAYTTYTGGGAR (SEQ ID NO: 484) |
| 90 | +TY + AAT + AARAGAACTCARGAYTTYTGGGAR (SEQ ID NO: 485) |
| 90 | +TYA + AT + AARAGAACTCARGAYTTYTGGGAR (SEQ ID NO: 486) |
| 90 | +TY + A + ATAARAGAACTCARGAYTTYTGGGAR (SEQ ID NO: 487) |
| 90 | +C + TYA + ATAARAGAACTCARGAYTTYTGGGAR (SEQ ID NO: 488) |
| 90 | +CTY + A + ATAARAGAACTCARGAYTTYTGGGAR (SEQ ID NO: 489) |
| 90 | +C + TY + AATAARAGAACTCARGAYTTYTGGGAR (SEQ ID NO: 490) |
| 90 | +AR + CTY + AATAARAGAACTCARGAYTTYTGGGAR (SEQ ID NO: 491) |
| 90 | +ARC + TY + AATAARAGAACTCARGAYTTYTGGGAR (SEQ ID NO: 492) |
| 90 | +AR + C + TYAATAARAGAACTCARGAYTTYTGGGAR (SEQ ID NO: 493) |
| 90 | YT + TYA + GR + GARCTYAATAARAGAACTCARGAYTTYTGGGAR (SEQ ID NO: 494) |

TABLE 5 -continued

| | |
|---|---|
| 98 | GAYTTYTGGGARGTYCAATTAGGRATACCNCAYCCHG (SEQ ID NO: 495) |
| 98 | ARGAYTTYTGGGARGTYCAATTAGGRATACCNCAYCCHG (SEQ ID NO: 496) |
| 98 | CARGAYTTYTGGGARGTYCAATTAGGRATACCNCAYCCHG (SEQ ID NO: 497) |
| 98 | TYTGGGARGTYCAATTAGGRATACCNCAYCCHG (SEQ ID NO: 498) |
| 98 | TTYTGGGARGTYCAATTAGGRATACCNCAYCCHG (SEQ ID NO: 499) |
| 98 | AYTTYTGGGARGTYCAATTAGGRATACCNCAYCCHG (SEQ ID NO: 500) |
| 98 | ARAACTCARGAYTTYTGGGARGTYCARTTAGGRATACCDCATCCA (SEQ ID NO: 501) |
| 98 | GAYTTYTGGGARGTYCAATTAGGRATACCNCAYCCHG + N (SEQ ID NO: 502) |
| 98 | ARGAYTTYTGGGARGTYCAATTAGGRATACCNCAYCCHG + N (SEQ ID NO: 503) |
| 98 | CARGAYTTYTGGGARGTYCAATTAGGRATACCNCAYCCHG + N (SEQ ID NO: 504) |
| 98 | TYTGGGARGTYCAATTAGGRATACCNCAYCCHG + N (SEQ ID NO: 505) |
| 98 | TTYTGGGARGTYCAATTAGGRATACCNCAYCCHG + N (SEQ ID NO: 506) |
| 98 | AYTTYTGGGARGTYCAATTAGGRATACCNCAYCCHG + N (SEQ ID NO: 507) |
| 98 | ARAACTCARGAYTTYTGGGARGTYCARTTAGGRATACCDCATCCA + N (SEQ ID NO: 508) |
| 98 | +G + AYT + TYTGGGARGTYCAATTAGGRATACCNCAYCCHG (SEQ ID NO: 509) |
| 98 | +GAY + T + TYTGGGARGTYCAATTAGGRATACCNCAYCCHG (SEQ ID NO: 510) |
| 98 | +G + AY + TTYTGGGARGTYCAATTAGGRATACCNCAYCCHG (SEQ ID NO: 511) |
| 98 | +AR + GAY + TTYTGGGARGTYCAATTAGGRATACCNCAYCCHG (SEQ ID NO: 512) |
| 98 | +ARG + AY + TTYTGGGARGTYCAATTAGGRATACCNCAYCCHG (SEQ ID NO: 513) |
| 98 | +AR + G + AYTTYTGGGARGTYCAATTAGGRATACCNCAYCCHG (SEQ ID NO: 514) |
| 98 | +C + ARG + AYTTYTGGGARGTYCAATTAGGRATACCNCAYCCHG (SEQ ID NO: 515) |
| 98 | +CAR + G + AYTTYTGGGARGTYCAATTAGGRATACCNCAYCCHG (SEQ ID NO: 516) |
| 98 | +TY + TGGG + ARGTYCAATTAGGRATACCNCAYCCHG (SEQ ID NO: 517) |
| 98 | +TYTGG+ +G + ARGTYCAATTAGGRATACCNCAYCCHG (SEQ ID NO: 518) |
| 98 | +TY + TGG + GARGTYCAATTAGGRATACCNCAYCCHG (SEQ ID NO: 519) |
| 98 | +T + TYTGG + GARGTYCAATTAGGRATACCCAYCCHG (SEQ ID NO: 520) |
| 98 | +TTY + TGG + GARGTYCAATTAGGRATACCNCAYCCHG (SEQ ID NO: 521) |
| 98 | +T + TY + TGGGARGTYCAATTAGGRATACCNCAYCCHG (SEQ ID NO: 522) |
| 98 | +AY + TTY + TGGGARGTYCAATTAGGRATACCNCAYCCHG (SEQ ID NO: 523) |
| 98 | +AYT + TY + TGGGARGTYCAATTAGGRATACCNCAYCCHG (SEQ ID NO: 524) |
| 98 | +AY + T + TYTGGGARGTYCAATTAGGRATACCNCAYCCHG (SEQ ID NO: 525) |
| 98 | +C + AR + GAYTTYTGGGARGTYCAATTAGGRATACCNCAYCCHG (SEQ ID NO: 526) |
| 100 | TGGGARGTYCAATTAGGRATACCNCAYCCHGCRGGD (SEQ ID NO: 527) |
| 100 | TYTGGGARGTYCAATTAGGRATACCNCAYCCHGCRGGD (SEQ ID NO: 528) |
| 100 | YTTYTGGGARGTYCAATTAGGRATACCNCAYCCHGCRGGD (SEQ ID NO: 529) |
| 100 | TYCAATTAGGRATACCNCAYCCHGCRGGD (SEQ ID NO: 530) |

TABLE 5 -continued

| | |
|---|---|
| 100 | ARGTYCAATTAGGRATACCNCAYCCHGCRGGD (SEQ ID NO: 531) |
| 100 | GARGTYCAATTAGGRATACCNCAYCCHGCRGGD (SEQ ID NO: 532) |
| 100 | CARGAYTTYTGGGARGTYCARTTAGGRATACCDCAYCCAGCAGGG (SEQ ID NO: 533) |
| 100 | TGGGARGTYCAATTAGGRATACCNCAYCCHGCRGGD + N (SEQ ID NO: 534) |
| 100 | TYTGGGARGTYCAATTAGGRATACCNCAYCCHGCRGGD + N (SEQ ID NO: 535) |
| 100 | YTTYTGGGARGTYCAATTAGGRATACCNCAYCCHGCRGGD + N (SEQ ID NO: 536) |
| 100 | TYCAATTAGGRATACCNCAYCCHGCRGGD + N (SEQ ID NO: 537) |
| 100 | ARGTYCAATTAGGRATACCNCAYCCHGCRGGD + N (SEQ ID NO: 538) |
| 100 | GARGTYCAATTAGGRATACCNCAYCCHGCRGGD + N (SEQ ID NO: 539) |
| 100 | CARGAYTTYTGGGARGTYCARTTAGGRATACCDCAYCCAGCAGGG + N (SEQ ID NO: 540) |
| 100 | +TGG + GARG + TYCAATTAGGRATACCNCAYCCHGCRGGD (SEQ ID NO: 541) |
| 100 | +TGGG + ARG + TYCAATTAGGRATACCNCAYCCHGCRGGD (SEQ ID NO: 542) |
| 100 | +TGG + G + ARGTYCAATTAGGRATACCNCAYCCHGCRGGD (SEQ ID NO: 543) |
| 100 | +TY + TGGG + ARGTYCAATTAGGRATACCNCAYCCHGCRGGD (SEQ ID NO: 544) |
| 100 | +TYTGG + G + ARGTYCAATTAGGRATACCNCAYCCHGCRGGD (SEQ ID NO: 545) |
| 100 | +TY + TGG + GARGTYCAATTAGGRATACCNCAYCCHGCRGGD (SEQ ID NO: 546) |
| 100 | Y + T + TYTGG + GARGTYCAATTAGGRATACCNCAYCCHGCRGGD (SEQ ID NO: 547) |
| 100 | Y + TTY + TGG + GARGTYCAATTAGGRATACCNCAYCCHGCRGGD (SEQ ID NO: 548) |
| 100 | +TY + CAAT + TAGGRATACCNCAYCCHGCRGGD (SEQ ID NO: 549) |
| 100 | +TYC + AAT + TAGGRATACCNCAYCCHGCRGGD (SEQ ID NO: 550) |
| 100 | +TY + C + AATTAGGRATACCNCAYCCHGCRGGD (SEQ ID NO: 551) |
| 100 | +ARG + TYC + AATTAGGRATACCNCAYCCHGCRGGD (SEQ ID NO: 552) |
| 100 | +ARGTY + C + AATTAGGRATACCNCAYCCHGCRGGD (SEQ ID NO: 553) |
| 100 | +ARG + TY + CAATTAGGRATACCNCAYCCHGCRGGD (SEQ ID NO: 554) |
| 100 | +G + ARGTY + CAATTAGGRATACCNCAYCCHGCRGGD (SEQ ID NO: 555) |
| 100 | +GARG + TY + CAATTAGGRATACCNCAYCCHGCRGGD (SEQ ID NO: 556) |
| 100 | +G + ARG + TYCAATTAGGRATACCNCAYCCHGCRGGD (SEQ ID NO: 557) |
| 100 | Y + T + TY + TGGGARGTYCAATTAGGRATACCNCAYCCHGCRGGD (SEQ ID NO: 558) |
| 101 | ARGTYCAATTAGGRATACCNCAYCCHGCRGGDYTA (SEQ ID NO: 559) |
| 101 | GARGTYCAATTAGGRATACCNCAYCCHGCRGGDYTA (SEQ ID NO: 560) |
| 101 | YTGGGARGTYCAATTAGGRATACCNCAYCCHGCRGGDYTA (SEQ ID NO: 561) |
| 101 | AATTAGGRATACCNCAYCCHGCRGGDYTA (SEQ ID NO: 562) |
| 101 | CAATTAGGRATACCNCAYCCHGCRGGDYTA (SEQ ID NO: 563) |
| 101 | TYCAATTAGGRATACCNCAYCCHGCRGGDYTA (SEQ ID NO: 564) |
| 101 | GAYTTYTGGGARGTYCARTTAGGRATACCDCAYCCHGCRGGGTTA (SEQ ID NO: 565) |
| 101 | ARGTYCAATTAGGRATACCNCAYCCHGCRGGDYTA + N (SEQ ID NO: 566) |

TABLE 5 -continued

| | | |
|---|---|---|
| 101 | GARGTYCAATTAGGRATACCNCAYCCHGCRGGDYTA + N | (SEQ ID NO: 567) |
| 101 | YTGGGARGTYCAATTAGGRATACCNCAYCCHGCRGGDYTA + N | (SEQ ID NO: 568) |
| 101 | AATTAGGRATACCNCAYCCHGCRGGDYTA + N | (SEQ ID NO: 569) |
| 101 | CAATTAGGRATACCNCAYCCHGCRGGDYTA + N | (SEQ ID NO: 570) |
| 101 | TYCAATTAGGRATACCNCAYCCHGCRGGDYTA + N | (SEQ ID NO: 571) |
| 101 | GAYTTYTGGGARGTYCARTTAGGRATACCDCAYCCHGCRGGGTTA + N | (SEQ ID NO: 572) |
| 101 | +ARG + TYC + AATTAGGRATACCNCAYCCHGCRGGDYTA | (SEQ ID NO: 573) |
| 101 | +ARGTY + C + AATTAGGRATACCNCAYCCHGCRGGDYTA | (SEQ ID NO: 574) |
| 101 | +ARG + TY + CAATTAGGRATACCNCAYCCHGCRGGDYTA | (SEQ ID NO: 575) |
| 101 | +G + ARGTY + CAATTAGGRATACCNCAYCCHGCRGGDYTA | (SEQ ID NO: 576) |
| 101 | +GARG + TY + CAATTAGGRATACCNCAYCCHGCRGGDYTA | (SEQ ID NO: 577) |
| 101 | +G + ARG + TYCAATTAGGRATACCNCAYCCHGCRGGDYTA | (SEQ ID NO: 578) |
| 101 | Y + TGG + GARG + TYCAATTAGGRATACCNCAYCCHGCRGGDYTA | (SEQ ID NO: 579) |
| 101 | Y + TGGG + ARG + TYCAATTAGGRATACCNCAYCCHGCRGGDYTA | (SEQ ID NO: 580) |
| 101 | +AAT + TAG + GRATACCNCAYCCHGCRGGDYTA | (SEQ ID NO: 581) |
| 101 | +AATTA + G + GRATACCNCAYCCHGCRGGDYTA | (SEQ ID NO: 582) |
| 101 | +AAT + TA + GGRATACCNCAYCCHGCRGGDYTA | (SEQ ID NO: 583) |
| 101 | +C + AATTA + GGRATACCNCAYCCHGCRGGDYTA | (SEQ ID NO: 584) |
| 101 | +CAAT + TA + GGRATACCNCAYCCHGCRGGDYTA | (SEQ ID NO: 585) |
| 101 | +C + AAT + TAGGRATACCNCAYCCHGCRGGDYTA | (SEQ ID NO :586) |
| 101 | +TY + CAAT + TAGGRATACCNCAYCCHGCRGGDYTA | (SEQ ID NO: 587) |
| 101 | +TYC + AAT + TAGGRATACCNCAYCCHGCRGGDYTA | (SEQ ID NO: 588) |
| 101 | +TY + C + AATTAGGRATACCNCAYCCHGCRGGDYTA | (SEQ ID NO: 589) |
| 101 | Y + TGG + G + ARGTYCAATTAGGRATACCNCAYCCHGCRGGDYTA | (SEQ ID NO: 590) |
| 103 | AATTAGGRATACCNCAYCCHGCRGGDYTAAAAAAGAA | (SEQ ID NO: 591) |
| 103 | CAATTAGGRATACCNCAYCCHGCRGGDYTAAAAAAGAA | (SEQ ID NO: 592) |
| 103 | TYCAATTAGGRATACCNCAYCCHGCRGGDYTAAAAAAGAA | (SEQ ID NO: 593) |
| 103 | GRATACCNCAYCCHGCRGGDYTAAAAAAGAA | (SEQ ID NO: 594) |
| 103 | GGRATACCNCAYCCHGCRGGDYTAAAAAAGAA | (SEQ ID NO: 595) |
| 103 | TAGGRATACCNCAYCCHGCRGGDYTAAAAAAGAA | (SEQ ID NO: 596) |
| 103 | TGGGARGTYCARTTAGGRATACCDCAYCCHGCRGGDYTAAAAAG | (SEQ ID NO: 597) |
| 103 | AATTAGGRATACCNCAYCCHGCRGGDYTAAAAAAGAA + N | (SEQ ID NO: 598) |
| 103 | CAATTAGGRATACCNCAYCCHGCRGGDYTAAAAAAGAA + N | (SEQ ID NO: 599) |
| 103 | TYCAATTAGGRATACCNCAYCCHGCRGGDYTAAAAAAGAA + N | (SEQ ID NO: 600) |
| 103 | GRATACCNCAYCCHGCRGGDYTAAAAAAGAA + N | (SEQ ID NO: 601) |
| 103 | GGRATACCNCAYCCHGCRGGDYTAAAAAAGAA + N | (SEQ ID NO: 602) |
| 103 | TAGGRATACCNCAYCCHGCRGGDYTAAAAAAGAA + N | (SEQ ID NO: 603) |

TABLE 5 -continued

| | |
|---|---|
| 103 | TGGGARGTYCARTTAGGRATACCDCAYCCHGCRGGDYTAAAAAG + N (SEQ ID NO: 604) |
| 103 | +AAT + TAG + GRATACCNCAYCCHGCRGGDYTAAAAAAGAA (SEQ ID NO: 605) |
| 103 | +AATTA + G + GRATACCNCAYCCHGCRGGDYTAAAAAAGAA (SEQ ID NO: 606) |
| 103 | +AAT + TA + GGRATACCNCAYCCHGCRGGDYTAAAAAAGAA (SEQ ID NO: 607) |
| 103 | +C + AATTA + GGRATACCNCAYCCHGCRGGDYTAAAAAAGAA (SEQ ID NO: 608) |
| 103 | +CAAT + TA + GGRATACCNCAYCCHGCRGGDYTAAAAAAGAA (SEQ ID NO: 609) |
| 103 | +C + AAT + TAGGRATACCNCAYCCHGCRGGDYTAAAAAAGAA (SEQ ID NO: 610) |
| 103 | +TY + CAAT + TAGGRATACCMCAUCCJGCRGGDUTAAAAAAGAA (SEQ ID NO: 611) |
| 103 | +TYC + AAT + TAGGRATACCNCAYCCHGCRGGDYTAAAAAAGAA (SEQ ID NO: 612) |
| 103 | +GR + ATA + CCNCAYCCHGCRGGDYTAAAAAAGAA (SEQ ID NO: 613) |
| 103 | +GRA + TA + CCNCAYCCHGCRGGDYTAAAAAAGAA (SEQ ID NO: 614) |
| 103 | +GR + A + TACCNCAYCCHGCRGGDYTAAAAAAGAA (SEQ ID NO: 615) |
| 103 | +G + GRA + TACCNCAYCCHGCRGGDYTAAAAAAGAA (SEQ ID NO: 616) |
| 103 | +GGR + A + TACCNCAYCCHGCRGGDYTAAAAAAGAA (SEQ ID NO: 617) |
| 103 | +G + GR + ATACCNCAYCCHGCRGGDYTAAAAAAGAA (SEQ ID NO: 618) |
| 103 | +TA + GGR + ATACCNCAYCCHGCRGGDYTAAAAAAGAA (SEQ ID NO: 619) |
| 103 | +TAG + GR + ATACCNCAYCCHGCRGGDYTAAAAAAGAA (SEQ ID NO: 620) |
| 103 | +TA + G + GRATACCNCAYCCHGCRGGDYTAAAAAAGAA (SEQ ID NO: 621) |
| 103 | +TY + C + AATTAGGRATACCNCAYCCHGCRGGDYTAAAAAAGAA (SEQ ID NO: 622) |
| 106 | ATACCNCAYCCHGCRGGDYTAAAAAAGAAMAAATCAG (SEQ ID NO: 623) |
| 106 | GRATACCNCAYCCHGCRGGDYTAAAAAAGAAMAAATCAG (SEQ ID NO: 624) |
| 106 | GGRATACCNCAYCCHGCRGGDYTAAAAAAGAAMAAATCAG (SEQ ID NO: 625) |
| 106 | CNCAYCCHGCRGGDYTAAAAAAGAAMAAATCAG (SEQ ID NO: 626) |
| 106 | CCNCAYCCHGCRGGDYTAAAAAAGAAMAAATCAG (SEQ ID NO: 627) |
| 106 | TACCNCAYCCHGCRGGDYTAAAAAAGAAMAAATCAG (SEQ ID NO: 628) |
| 106 | CARTTAGGRATACCDCAYCCHGCRGGDYTAAARAAGAARAAATCA (SEQ ID NO: 629) |
| 106 | ATACCNCAYCCHGCRGGDYTAAAAAAGAAMAAATCAG + N (SEQ ID NO: 630) |
| 106 | GRATACCNCAYCCHGCRGGDYTAAAAAAGAAMAAATCAG + N (SEQ ID NO: 631) |
| 106 | GGRATACCNCAYCCHGCRGGDYTAAAAAAGAAMAAATCAG + N (SEQ ID NO: 632) |
| 106 | CNCAYCCHGCRGGDYTAAAAAAGAAMAAATCAG + N (SEQ ID NO: 633) |
| 106 | CCNCAYCCHGCRGGDYTAAAAAAGAAMAAATCAG + N (SEQ ID NO: 634) |
| 106 | TACCNCAYCCHGCRGGDYTAAAAAAGAAMAAATCAG + N (SEQ ID NO: 635) |
| 106 | CARTTAGGRATACCDCAYCCHGCRGGDYTAAARAAGAARAAATCA + N (SEQ ID NO: 636) |

TABLE 5 -continued

| | |
|---|---|
| 106 | +A + TAC + CNCAYCCHGCRGGDYTAAAAAAGAAMAAATCAG (SEQ ID NO: 637) |
| 106 | +ATA + C + CNCAYCCHGCRGGDYTAAAAAAGAAMAAATCAG (SEQ ID NO: 638) |
| 106 | +A + TA + CCNCAYCCHGCRGGDYTAAAAAAGAAMAAATCAG (SEQ ID NO: 639) |
| 106 | +GR + ATA + CCNCAYCCHGCRGGDYTAAAAAAGAAMAAATCAG (SEQ ID NO: 640) |
| 106 | +GRA + TA + CCNCAYCCHGCRGGDYTAAAAAAGAAMAAATCAG (SEQ ID NO: 641) |
| 106 | +GR + A + TACCNCAYCCHGCRGGDYTAAAAAAGAAMAAATCAG (SEQ ID NO: 642) |
| 106 | +G + GRA + TACCNCAYCCHGCRGGDYTAAAAAAGAAMAAATCAG (SEQ ID NO: 643) |
| 106 | +GGR + A + TACCNCAYCCHGCRGGDYTAAAAAAGAAMAAATCAG (SEQ ID NO: 644) |
| 106 | +CN + CAY + CCHGCRGGDYTAAAAAAGAAMAAATCAG (SEQ ID NO: 645) |
| 106 | +CNC + AY + CCHGCRGGDYTAAAAAAGAAMAAATCAG (SEQ ID NO: 646) |
| 106 | +CN + C + AYCCHGCRGGDYTAAAAAAGAAMAAATCAG (SEQ ID NO: 647) |
| 106 | +C + CNC + AYCCHGCRGGDYTAAAAAAGAAMAAATCAG (SEQ ID NO: 648) |
| 106 | +CCN + C + AYCCHGCRGGDYTAAAAAAGAAMAAATCAG (SEQ ID NO: 649) |
| 106 | +C + CN + CAYCCHGCRGGDYTAAAAAAGAAMAAATCAG (SEQ ID NO: 650) |
| 106 | +TA + CCN + CAYCCHGCRGGDYTAAAAAAGAAMAAATCAG (SEQ ID NO: 651) |
| 106 | +TAC + CN + CAYCCHGCRGGDYTAAAAAAGAAMAAATCAG (SEQ ID NO: 652) |
| 106 | +TA + C + CNCAYCCHGCRGGDYTAAAAAAGAAMAAATCAG (SEQ ID NO: 653) |
| 106 | +G + GR + ATACCNCAYCCHGCRGGDYTAAAAAAGAAMAAATCAG (SEQ ID NO: 654) |
| 108 | CAYCCHGCRGGDYTAAAAAAGAAMAAATCAGTRACA (SEQ ID NO: 655) |
| 108 | CNCAYCCHGCRGGDYTAAAAAAGAAMAAATCAGTRACA (SEQ ID NO: 656) |
| 108 | ACCNCAYCCHGCRGGDYTAAAAAAGAAMAAATCAGTRACA (SEQ ID NO: 657) |
| 108 | CHGCRGGDYTAAAAAAGAAMAAATCAGTRACA (SEQ ID NO: 658) |
| 108 | CCHGCRGGDYTAAAAAAGAAMAAATCAGTRACA (SEQ ID NO: 659) |
| 108 | AYCCHGCRGGDYTAAAAAAGAAMAAATCAGTRACA (SEQ ID NO: 660) |
| 108 | GGRATACCDCAYCCHGCRGGDYTAAARAAGAARAARTCWGTAACA (SEQ ID NO: 661) |
| 108 | CAYCCHGCRGGDYTAAAAAAGAAMAAATCAGTRACA + N (SEQ ID NO: 662) |
| 108 | CNCAYCCHGCRGGDYTAAAAAAGAAMAAATCAGTRACA + N (SEQ ID NO: 663) |
| 108 | ACCNCAYCCHGCRGGDYTAAAAAAGAAMAAATCAGTRACA + N (SEQ ID NO: 664) |
| 108 | CHGCRGGDYTAAAAAAGAAMAAATCAGTRACA + N (SEQ ID NO: 665) |
| 108 | CCHGCRGGDYTAAAAAAGAAMAAATCAGTRACA + N (SEQ ID NO: 666) |
| 108 | AYCCHGCRGGDYTAAAAAAGAAMAAATCAGTRACA + N (SEQ ID NO: 667) |
| 108 | GGRATACCDCAYCCHGCRGGDYTAAARAAGAARAARTCWGTAACA + N (SEQ ID NO: 668) |
| 108 | +C + AYC + CHGCRGGDYTAAAAAAGAAMAAATCAGTRACA (SEQ ID NO: 669) |
| 108 | +CAY + C + CHGCRGGDYTAAAAAAGAAMAAATCAGTRACA (SEQ ID NO: 670) |
| 108 | +C + AY + CCHGCRGGDYTAAAAAAGAAMAAATCAGTRACA (SEQ ID NO: 671) |

TABLE 5 -continued

| | |
|---|---|
| 108 | +CN + CAY + CCHGCRGGDYTAAAAAAGAAMAAATCAGTRACA (SEQ ID NO: 672) |
| 108 | +CNC + AY + CCHGCRGGDYTAAAAAAGAAMAAATCAGTRACA (SEQ ID NO: 673) |
| 108 | +CN + C + AYCCHGCRGGDYTAAAAAAGAAMAAATCAGTRACA (SEQ ID NO: 674) |
| 108 | A + C + CNC + AYCCHGCRGGDYTAAAAAAGAAMAAATCAGTRACA (SEQ ID NO: 675) |
| 108 | A + CCN + C + AYCCHGCRGGDYTAAAAAAGAAMAAATCAGTRACA (SEQ ID NO: 676) |
| 108 | +CHGCR + GGDY + TAAAAAAGAAMAAATCAGTRACA (SEQ ID NO: 677) |
| 108 | +CHGCRG + GDY + TAAAAAAGAAMAAATCAGTRACA (SEQ ID NO: 678) |
| 108 | +CHGCR + G + GDYTAAAAAAGAAMAAATCAGTRACA (SEQ ID NO: 679) |
| 108 | +C + CHGCRG + GDYTAAAAAAGAAMAAATCAGTRACA (SEQ ID NO: 680) |
| 108 | +CCHGCR + G + GDYTAAAAAAGAAMAAATCAGTRACA (SEQ ID NO: 681) |
| 108 | +C + CHGCR + GGDYTAAAAAAGAAMAAATCAGTRACA (SEQ ID NO: 682) |
| 108 | +AY + CCHGCR + GGDYTAAAAAAGAAMAAATCAGTRACA (SEQ ID NO: 683) |
| 108 | +AYC + CHGCR + GGDYTAAAAAAGAAMAAATCAGTRACA (SEQ ID NO: 684) |
| 108 | +AY+C + CHGCRG GDYTAAAAAAGAAMAAATCAGTRACA (SEQ ID NO: 685) |
| 108 | A + C + CN + CAYCCHGCRGGDYTAAAAAAGAAMAAATCAGTRACA (SEQ ID NO: 686) |
| 115 | CAGTRACAGTRYTRGATGTRGGDGAYGCAT (SEQ ID NO: 687) |
| 115 | AAATCAGTRACAGTRYTRGATGTRGGDGAYGCAT (SEQ ID NO: 688) |
| 115 | AAGAAMAAATCAGTRACAGTRYTRGATGTRGGDGAYGCAT (SEQ ID NO: 689) |
| 115 | TRYTRGATGTRGGDGAYGCAT (SEQ ID NO: 690) |
| 115 | CAGTRYTRGATGTRGGDGAYGCAT (SEQ ID NO: 691) |
| 115 | YTAAARAAGAARAARTCWGTRACAGTVYTRGATGTRGGDGATGCA (SEQ ID NO: 692) |
| 115 | CAGTRACAGTRYTRGATGTRGGDGAYGCAT + N (SEQ ID NO: 693) |
| 115 | AAATCAGTRACAGTRYTRGATGTRGGDGAYGCAT + N (SEQ ID NO: 694) |
| 115 | AAGAAMAAATCAGTRACAGTRYTRGATGTRGGDGAYGCAT + N (SEQ ID NO: 695) |
| 115 | TRYTRGATGTRGGDGAYGCAT + N (SEQ ID NO: 696) |
| 115 | CAGTRYTRGATGTRGGDGAYGCAT + N (SEQ ID NO: 697) |
| 115 | YTAAARAAGAARAARTCWGTRACAGTVYTRGATGTRGGDGATGCA + N (SEQ ID NO: 698) |
| 115 | +CAGTRA + CAGTRY + TRGATGTRGGDGAYGCAT (SEQ ID NO: 699) |
| 115 | +CAGTRACAG + TRY + TRGATGTRGGDGAYGCAT (SEQ ID NO: 700) |
| 115 | +CAGTRA + CAG + TRYTRGATGTRGGDGAYGCAT (SEQ ID NO: 701) |
| 115 | +AAAT + CAGTRACAG + TRYTRGATGTRGGDGAYGCAT (SEQ ID NO: 702) |
| 115 | +AAATCAGTRA + CAG + TRYTRGATGTRGGDGAYGCAT (SEQ ID NO: 703) |
| 115 | +AAAT + CAGTRA + CAGTRYTRGATGTRGGDGAYGCAT (SEQ ID NO: 704) |
| 115 | AAG + AAM + AAATCAGTRA + CAGTRYTRGATGTRGGDGAYGCAT (SEQ ID NO: 705) |
| 115 | AAG + AAMAAAT + CAGTRA + CAGTRYTRGATGTRGGDGAYGCAT (SEQ ID NO: 706) |
| 115 | +TRY + TRG + ATGTRGGDGAYGCAT (SEQ ID NO: 707) |
| 115 | +TRYTR + G + ATGTRGGDGAYGCAT (SEQ ID NO: 708) |

TABLE 5 -continued

| | |
|---|---|
| 115 | +TRY + TR + GATGTRGGDGAYGCAT (SEQ ID NO: 709) |
| 115 | +CAG + TRYTR + GATGTRGGDGAYGCAT (SEQ ID NO: 710) |
| 115 | +CAGTRY + TR + GATGTRGGDGAYGCAT (SEQ ID NO: 711) |
| 115 | +CAG + TRY + TRGATGTRGGDGAYGCAT (SEQ ID NO: 712) |
| 115 | AAG + AAM + AAAT + CAGTRACAGTRYTRGATGTRGGDGAYGCAT (SEQ ID NO: 713) |
| 116 | CAGTRACAGTRYTRGATGTRGGDGAYGCATAYT (SEQ ID NO: 714) |
| 116 | AAATCAGTRACAGTRYTRGATGTRGGDGAYGCATAYT (SEQ ID NO: 715) |
| 116 | AAMAAATCAGTRACAGTRYTRGATGTRGGDGAYGCATAYT (SEQ ID NO: 716) |
| 116 | TRGATGTRGGDGAYGCATAYT (SEQ ID NO: 717) |
| 116 | TRYTRGATGTRGGDGAYGCATAYT (SEQ ID NO: 718) |
| 116 | CAGTRYTRGATGTRGGDGAYGCATAYT (SEQ ID NO: 719) |
| 116 | AARAAGAARAARTCWGTRACAGTVYTRGATGTRGGDGATGCATAT (SEQ ID NO: 720) |
| 116 | CAGTRACAGTRYTRGATGTRGGDGAYGCATAYT + N (SEQ ID NO: 721) |
| 116 | AAATCAGTRACAGTRYTRGATGTRGGDGAYGCATAYT + N (SEQ ID NO: 722) |
| 116 | AAMAAATCAGTRACAGTRYTRGATGTRGGDGAYGCATAYT + N (SEQ ID NO: 723) |
| 116 | TRGATGTRGGDGAYGCATAYT + N (SEQ ID NO: 724) |
| 116 | TRYTRGATGTRGGDGAYGCATAYT + N (SEQ ID NO: 725) |
| 116 | CAGTRYTRGATGTRGGDGAYGCATAYT + N (SEQ ID NO: 726) |
| 116 | AARAAGAARAARTCWGTRACAGTVYTRGATGTRGGDGATGCATAT + N (SEQ ID NO: 727) |
| 116 | +CAGTRA + CAGTRY + TRGATGTRGGDGAYGCATAYT (SEQ ID NO: 728) |
| 116 | +CAGTRACAG + TRY + TRGATGTRGGDGAYGCATAYT (SEQ ID NO: 729) |
| 116 | +CAGTRA + CAG + TRYTRGATGTRGGDGAYGCATAYT (SEQ ID NO: 730) |
| 116 | +AAAT + CAGTRACAG + TRYTRGATGTRGGDGAYGCATAYT (SEQ ID NO: 731) |
| 116 | +AAATCAGTRA + CAG + TRYTRGATGTRGGDGAYGCATAYT (SEQ ID NO: 732) |
| 116 | +AAAT + CAGTRA + CAGTRYTRGATGTRGGDGAYGCATAYT (SEQ ID NO: 733) |
| 116 | +AAM + AAATCAGTRA + CAGTRYTRGATGTRGGDGAYGCATAYT (SEQ ID NO: 734) |
| 116 | +AAMAAAT + CAGTRA + CAGTRYTRGATGTRGGDGAYGCATAYT (SEQ ID NO: 735) |
| 116 | +TR + GATG + TRGGDGAYGCATAYT (SEQ ID NO: 736) |
| 116 | +TRG + ATG + TRGGDGAYGCATAYT (SEQ ID NO: 737) |
| 116 | +TR + G + ATGTRGGDGAYGCATAYT (SEQ ID NO: 738) |
| 116 | +TRY + TRG + ATGTRGGDGAYGCATAYT (SEQ ID NO: 739) |
| 116 | +TRYTR + G + ATGTRGGDGAYGCATAYT (SEQ ID NO: 740) |
| 116 | +TRY + TR + GATGTRGGDGAYGCATAYT (SEQ ID NO: 741) |
| 116 | +CAG + TRYTR + GATGTRGGDGAYGCATAYT (SEQ ID NO: 742) |
| 116 | +CAGTRY + TR + GATGTRGGDGAYGCATAYT (SEQ ID NO: 743) |
| 116 | +CAG + TRY + TRGATGTRGGDGAYGCATAYT (SEQ ID NO: 744) |
| 116 | +AAM + AAAT + CAGTRACAGTRYTRGATGTRGGDGAYGCATAYT (SEQ ID NO: 745) |

TABLE 5 -continued

| 118 | TRYTRGATGTRGGDGAYGCATAYTTYTCA (SEQ ID NO: 746) |
| --- | --- |
| 118 | CAGTRYTRGATGTRGGDGAYGCATAYTTYTCA (SEQ ID NO: 747) |
| 118 | ATCAGTRACAGTRYTRGATGTRGGDGAYGCATAYTTYTCA (SEQ ID NO: 748) |
| 118 | ATGTRGGDGAYGCATAYTTYTCA (SEQ ID NO: 749) |
| 118 | GATGTRGGDGAYGCATAYTTYTCA (SEQ ID NO: 750) |
| 118 | TRGATGTRGGDGAYGCATAYTTYTCA (SEQ ID NO: 751) |
| 118 | AARAARTCWGTRACAGTVYTRGATGTRGGDGATGCATATTTTTCA (SEQ ID NO: 752) |
| 118 | TRYTRGATGTRGGDGAYGCATAYTTYTCA + N (SEQ ID NO: 753) |
| 118 | CAGTRYTRGATGTRGGDGAYGCATAYTTYTCA + N (SEQ ID NO: 754) |
| 118 | ATCAGTRACAGTRYTRGATGTRGGDGAYGCATAYTTYTCA + N (SEQ ID NO: 755) |
| 118 | ATGTRGGDGAYGCATAYTTYTCA + N (SEQ ID NO: 756) |
| 118 | GATGTRGGDGAYGCATAYTTYTCA + N (SEQ ID NO: 757) |
| 118 | TRGATGTRGGDGAYGCATAYTTYTCA + N (SEQ ID NO: 758) |
| 118 | AARAARTCWGTRACAGTVYTRGATGTRGGDGATGCATATTTTTCA + N (SEQ ID NO: 759) |
| 118 | +TRY + TRG + ATGTRGGDGAYGCATAYTTYTCA (SEQ ID NO: 760) |
| 118 | +TRYTR + G + ATGTRGGDGAYGCATAYTTYTCA (SEQ ID NO: 761) |
| 118 | +TRY + TR + GATGTRGGDGAYGCATAYTTYTCA (SEQ ID NO: 762) |
| 118 | +CAG + TRYTR + GATGTRGGDGAYGCATAYTTYTCA (SEQ ID NO: 763) |
| 118 | +CAGTRY + TR + GATGTRGGDGAYGCATAYTTYTCA (SEQ ID NO: 764) |
| 118 | +CAG + TRY + TRGATGTRGGDGAYGCATAYTTYTCA (SEQ ID NO: 765) |
| 118 | AT + CAGTRA + CAGTRY + TRGATGTRGGDGAYGCATAYTTYTCA (SEQ ID NO: 766) |
| 118 | AT + CAGTRACAG + TRY + TRGATGTRGGDGAYGCATAYTTYTCA (SEQ ID NO: 767) |
| 118 | +ATG + TRG + GDGAYGCATAYTTYTCA (SEQ ID NO: 768) |
| 118 | +ATGTR + G + GDGAYGCATAYTTYTCA (SEQ ID NO: 769) |
| 118 | +ATG + TR + GGDGAYGCATAYTTYTCA (SEQ ID NO: 770) |
| 118 | +G + ATGTR + GGDGAYGCATAYTTYTCA (SEQ ID NO: 771) |
| 118 | +GATG + TR + GGDGAYGCATAYTTYTCA (SEQ ID NO: 772) |
| 118 | +G + ATG + TRGGDGAYGCATAYTTYTCA (SEQ ID NO: 773) |
| 118 | +TR + GATG + TRGGDGAYGCATAYTTYTCA (SEQ ID NO: 774) |
| 118 | +TRG + ATG + TRGGDGAYGCATAYTTYTCA (SEQ ID NO: 775) |
| 118 | +TR + G + ATGTRGGDGAYGCATAYTTYTCA (SEQ ID NO: 776) |
| 118 | AT + CAGTRA + CAG + TRYTRGATGTRGGDGAYGCATAYTTYTCA (SEQ ID NO: 777) |
| 138 | AARTAYACTGCATTYACYATACCTAGTRYAAAYAAT (SEQ ID NO: 778) |
| 138 | AARTAYACTGCATTYACYATACCTAGTRYAAAYAATG (SEQ ID NO: 779) |
| 138 | GRAARTAYACTGCATTYACYATACCTAGTRYAAAYAAT (SEQ ID NO: 780) |
| 138 | GRAARTAYACTGCATTYACYATACCTAGTRYAAAYAATG (SEQ ID NO: 781) |
| 138 | YAGRAARTAYACTGCATTYACYATACCTAGTRYAAAYAAT (SEQ ID NO: 782) |

TABLE 5 -continued

| | | |
|---|---|---|
| 138 | AGRAARTAYACTGCATTYACYATACCTAGTRYAAAYAATG | (SEQ ID NO: 783) |
| 138 | AYACTGCATTYACYATACCTAGTRYAAAYAAT | (SEQ ID NO: 784) |
| 138 | AYACTGCATTYACYATACCTAGTRYAAAYAATG | (SEQ ID NO: 785) |
| 138 | TAYACTGCATTYACYATACCTAGTRYAAAYAAT | (SEQ ID NO: 786) |
| 138 | TAYACTGCATTYACYATACCTAGTRYAAAYAATG | (SEQ ID NO: 787) |
| 138 | ARTAYACTGCATTYACYATACCTAGTRYAAAYAAT | (SEQ ID NO: 788) |
| 138 | ARTAYACTGCATTYACYATACCTAGTRYAAAYAATG | (SEQ ID NO: 789) |
| 138 | RRHTTYAGRAARTAYACTGCATTYACYATACCYAGTRYMAACAAT | (SEQ ID NO: 790) |
| 138 | AARTAYACTGCATTYACYATACCTAGTRYAAAYAAT + N | (SEQ ID NO: 791) |
| 138 | AARTAYACTGCATTYACYATACCTAGTRYAAAYAATG + N | (SEQ ID NO: 792) |
| 138 | GRAARTAYACTGCATTYACYATACCTAGTRYAAAYAAT + N | (SEQ ID NO: 793) |
| 138 | GRAARTAYACTGCATTYACYATACCTAGTRYAAAYAATG + N | (SEQ ID NO: 794) |
| 138 | YAGRAARTAYACTGCATTYACYATACCTAGTRYAAAYAAT + N | (SEQ ID NO: 795) |
| 138 | AGRAARTAYACTGCATTYACYATACCTAGTRYAAAYAATG + N | (SEQ ID NO: 796) |
| 138 | AYACTGCATTYACYATACCTAGTRYAAAYAAT + N | (SEQ ID NO: 797) |
| 138 | AYACTGCATTYACYATACCTAGTRYAAAYAATG + N | (SEQ ID NO: 798) |
| 138 | TAYACTGCATTYACYATACCTAGTRYAAAYAAT + N | (SEQ ID NO: 799) |
| 138 | TAYACTGCATTYACYATACCTAGTRYAAAYAATG + N | (SEQ ID NO: 800) |
| 138 | ARTAYACTGCATTYACYATACCTAGTRYAAAYAAT + N | (SEQ ID NO: 801) |
| 138 | ARTAYACTGCATTYACYATACCTAGTRYAAAYAATG + N | (SEQ ID NO: 802) |
| 138 | RRHTTYAGRAARTAYACTGCATTYACYATACCYAGTRYMAACAAT + N | (SEQ ID NO: 803) |
| 138 | +A + ART + AYACTGCATTYACYATACCTAGTRYAAAYAAT | (SEQ ID NO: 804) |
| 138 | +A + ART + AYACTGCATTYACYATACCTAGTRYAAAYAATG | (SEQ ID NO: 805) |
| 138 | +AAR + T + AYACTGCATTYACYATACCTAGTRYAAAYAAT | (SEQ ID NO: 806) |
| 138 | +AAR + T + AYACTGCATTYACYATACCTAGTRYAAAYAATG | (SEQ ID NO: 807) |
| 138 | +A + AR + TAYACTGCATTYACYATACCTAGTRYAAAYAAT | (SEQ ID NO: 808) |
| 138 | +A + AR + TAYACTGCATTYACYATACCTAGTRYAAAYAATG | (SEQ ID NO: 809) |
| 138 | +GR + AAR + TAYACTGCATTYACYATACCTAGTRYAAAYAAT | (SEQ ID NO: 810) |
| 138 | +GR + AAR + TAYACTGCATTYACYATACCTAGTRYAAAYAATG | (SEQ ID NO: 811) |
| 138 | +GRA + AR + TAYACTGCATTYACYATACCTAGTRYAAAYAAT | (SEQ ID NO: 812) |
| 138 | +GRA + AR + TAYACTGCATTYACYATACCTAGTRYAAAYAATG | (SEQ ID NO: 813) |
| 138 | +GR + A + ARTAYACTGCATTYACYATACCTAGTRYAAAYAAT | (SEQ ID NO: 814) |
| 138 | +GR + A + ARTAYACTGCATTYACYATACCTAGTRYAAAYAATG | (SEQ ID NO: 815) |
| 138 | Y + A + GRA + ARTAYACTGCATTYACYATACCTAGTRYAAAYAAT | (SEQ ID NO: 816) |
| 138 | +A + GRA + ARTAYACTGCATTYACYATACCTAGTRYAAAYAATG | (SEQ ID NO: 817) |
| 138 | Y + AGR + A + ARTAYACTGCATTYACYATACCTAGTRYAAAYAAT | (SEQ ID NO: 818) |

TABLE 5 -continued

| | | |
|---|---|---|
| 138 | +AGR + A + ARTAYACTGCATTYACYATACCTAGTRYAAAYAATG | (SEQ ID NO: 819) |
| 138 | +AY + ACT + GCATTYACYATACCTAGTRYAAAYAAT | (SEQ ID NO: 820) |
| 138 | +AY + ACT + GCATTYACYATACCTAGTRYAAAYAATG | (SEQ ID NO: 821) |
| 138 | +AYA + CT + GCATTYACYATACCTAGTRYAAAYAAT | (SEQ ID NO: 822) |
| 138 | +AYA + CT + GCATTYACYATACCTAGTRYAAAYAATG | (SEQ ID NO: 823) |
| 138 | +AY + A + CTGCATTYACYATACCTAGTRYAAAYAAT | (SEQ ID NO: 824) |
| 138 | +AY + A + CTGCATTYACYATACCTAGTRYAAAYAATG | (SEQ ID NO: 825) |
| 138 | +T + AYA + CTGCATTYACYATACCTAGTRYAAAYAAT | (SEQ ID NO: 826) |
| 138 | +T + AYA+ ACTGCATTYACYATACCTAGTRYAAAYAATG | (SEQ ID NO: 827) |
| 138 | +TAY + A + CTGCATTYACYATACCTAGTRYAAAYAAT | (SEQ ID NO: 828) |
| 138 | +TAY + A + CTGCATTYACYATACCTAGTRYAAAYAATG | (SEQ ID NO: 829) |
| 138 | +T + AY + ACTGCATTYACYATACCTAGTRYAAAYAAT | (SEQ ID NO: 830) |
| 138 | +T + AY + ACTGCATTYACYATACCTAGTRYAAAYAATG | (SEQ ID NO: 831) |
| 138 | +AR + TAY + ACTGCATTYACYATACCTAGTRYAAAYAAT | (SEQ ID NO: 832) |
| 138 | +AR + TAY + ACTGCATTYACYATACCTAGTRYAAAYAATG | (SEQ ID NO: 833) |
| 138 | +ART + AY + ACTGCATTYACYATACCTAGTRYAAAYAAT | (SEQ ID NO: 834) |
| 138 | +ART + AY + ACTGCATTYACYATACCTAGTRYAAAYAATG | (SEQ ID NO: 835) |
| 138 | +AR + T + AYACTGCATTYACYATACCTAGTRYAAAYAAT | (SEQ ID NO: 836) |
| 138 | +AR + T + AYACTGCATTYACYATACCTAGTRYAAAYAATG | (SEQ ID NO: 837) |
| 138 | Y + A + GR + AARTAYACTGCATTYACYATACCTAGTRYAAAYAAT | (SEQ ID NO: 838) |
| 138 | +A + GR + AARTAYACTGCATTYACYATACCTAGTRYAAAYAATG | (SEQ ID NO: 839) |
| 151 | AAYAATGARACACCAGGRRTYAGRTATCARTAYAATGTRCTTCCA | (SEQ ID NO: 840) |
| 151 | AAYAATGARACACCAGGRRTYAGRTATCARTAYAATGTRCTTCCA + N | (SEQ ID NO: 841) |
| 179 | TYTTAGARCCYTTTAGRDHAMAAAAYCCAGAVATRR | (SEQ ID NO: 842) |
| 179 | TYTTAGARCCYTTTAGRDHAMAAAAYCCAGAVATR | (SEQ ID NO: 843) |
| 179 | ATYTTAGARCCYTTTAGRDHAMAAAAYCCAGAVATRR | (SEQ ID NO: 844) |
| 179 | ATYTTAGARCCYTTTAGRDHAMAAAAYCCAGAVATR | (SEQ ID NO: 845) |
| 179 | ARAATYTTAGARCCYTTTAGRDHAMAAAAYCCAGAVATRR | (SEQ ID NO: 846) |
| 179 | AARAATYTTAGARCCYTTTAGRDHAMAAAAYCCAGAVATR | (SEQ ID NO: 847) |
| 179 | CYTTTAGRDHAMAAAAYCCAGAVATRR | (SEQ ID NO: 848) |
| 179 | CYTTTAGRDHAMAAAAYCCAGAVATR | (SEQ ID NO: 849) |
| 179 | CCYTTTAGRDHAMAAAAYCCAGAVATRR | (SEQ ID NO: 850) |
| 179 | CCYTTTAGRDHAMAAAAYCCAGAVATR | (SEQ ID NO: 851) |
| 179 | TAGARCCYTTTAGRDHAMAAAAYCCAGAVATRR | (SEQ ID NO: 852) |
| 179 | TAGARCCYTTTAGRDHAMAAAAYCCAGAVATR | (SEQ ID NO: 853) |
| 179 | ATGACAARAATYTTAGARCCYTTTAGRRHRMARAAYCCAGACATA | (SEQ ID NO: 854) |
| 179 | TYTTAGARCCYTTTAGRDHAMAAAAYCCAGAVATRR + N | (SEQ ID NO: 855) |
| 179 | TYTTAGARCCYTTTAGRDHAMAAAAYCCAGAVATR + N | (SEQ ID NO: 856) |

TABLE 5 -continued

| | |
|---|---|
| 179 | ATYTTAGARCCYTTTAGRDHAMAAAAYCCAGAVATRR + N (SEQ ID NO: 857) |
| 179 | ATYTTAGARCCYTTTAGRDHAMAAAAYCCAGAVATR + N (SEQ ID NO: 858) |
| 179 | ARAATYTTAGARCCYTTTAGRDHAMAAAAYCCAGAVATRR + N (SEQ ID NO: 859) |
| 179 | AARAATYTTAGARCCYTTTAGRDHAMAAAAYCCAGAVATR + N (SEQ ID NO: 860) |
| 179 | CYTTTAGRDHAMAAAAYCCAGAVATRR + N (SEQ ID NO: 861) |
| 179 | CYTTTAGRDHAMAAAAYCCAGAVATR + N (SEQ ID NO: 862) |
| 179 | CCYTTTAGRDHAMAAAAYCCAGAVATRR + N (SEQ ID NO: 863) |
| 179 | CCYTTTAGRDHAMAAAAYCCAGAVATR + N (SEQ ID NO: 864) |
| 179 | TAGARCCYTTTAGRDHAMAAAAYCCAGAVATRR + N (SEQ ID NO: 865) |
| 179 | TAGARCCYTTTAGRDHAMAAAAYCCAGAVATR + N (SEQ ID NO: 866) |
| 179 | ATGACAARAATYTTAGARCCYTTTAGRRHRMARAAYCCAGACATA + N (SEQ ID NO: 867) |
| 179 | +TYT + TAGARC + CYTTTAGRDHAMAAAAYCCAGAVATRR (SEQ ID NO: 868) |
| 179 | +TYT + TAGARC + CYTTAGRDHAMAAAAYCCAGAVATR (SEQ ID NO: 869) |
| 179 | +TYTTAGAR + C + CYTTTAGRDHAMAAAAYCCAGAVATRR (SEQ ID NO: 870) |
| 179 | +TYTTAGAR + C + CYTTTAGRDHAMAAAAYCCAGAVATR (SEQ ID NO: 871) |
| 179 | +TYT + TAGAR + CCYTTTAGRDHAMAAAAYCCAGAVATRR (SEQ ID NO: 872) |
| 179 | +TYT + TAGAR + CCYTTTAGRDHAMAAAAYCCAGAVATR (SEQ ID NO: 873) |
| 179 | +A + TYTTAGAR + CCYTTTAGRDHAMAAAAYCCAGAVATRR (SEQ ID NO: 874) |
| 179 | +A + TYTTAGAR + CCYTTTAGRDHAMAAAAYCCAGAVATR (SEQ ID NO: 875) |
| 179 | +ATYT + TAGAR + CCYTTTAGRDHAMAAAAYCCAGAVATRR (SEQ ID NO: 876) |
| 179 | +ATYT + TAGAR + CCYTTTAGRDHAMAAAAYCCAGAVATR (SEQ ID NO: 877) |
| 179 | +A + TYT + TAGARCCYTTTAGRDHAMAAAAYCCAGAVATRR (SEQ ID NO: 878) |
| 179 | +A + TYT + TAGARCCYTTTAGRDHAMAAAAYCCAGAVATR (SEQ ID NO: 879) |
| 179 | +ARA + ATYT + TAGARCCYTTTAGRDHAMAAAAYCCAGAVATRR (SEQ ID NO: 880) |
| 179 | A + ARA + ATYT + TAGARCCYTTTAGRDHAMAAAAYCCAGAVATR (SEQ ID NO: 881) |
| 179 | +ARAA + TYT + TAGARCCYTTTAGRDHAMAAAAYCCAGAVATRR (SEQ ID NO: 882) |
| 179 | A + ARAA + TYT + TAGARCCYTTTAGRDHAMAAAAYCCAGAVATR (SEQ ID NO: 883) |
| 179 | +CY + TTTAGRDHAMAAA + AYCCAGAVATRR (SEQ ID NO: 884) |
| 179 | +CY + TTTAGRDHAMAAA + AYCCAGAVATR (SEQ ID NO: 885) |
| 179 | +CYTTT + AGRDHAMAAA + AYCCAGAVATRR (SEQ ID NO: 886) |
| 179 | +CYTTT + AGRDHAMAAA + AYCCAGAVATR (SEQ ID NO: 887) |
| 179 | +CY + TTT + AGRDHAMAAAAYCCAGAVATRR (SEQ ID NO: 888) |
| 179 | +CY + TTT + AGRDHAMAAAAYCCAGAVATR (SEQ ID NO: 889) |
| 179 | +C + CYTTT + AGRDHAMAAAAYCCAGAVATRR (SEQ ID NO: 890) |
| 179 | +C + CYTTT + AGRDHAMAAAAYCCAGAVATR (SEQ ID NO: 891) |
| 179 | +CCY + TTT + AGRDHAMAAAAYCCAGAVATRR (SEQ ID NO: 892) |
| 179 | +CCY + TTT + AGRDHAMAAAAYCCAGAVATR (SEQ ID NO: 893) |

TABLE 5 -continued

| | | |
|---|---|---|
| 179 | +C + CY + TTTAGRDHAMAAAAYCCAGAVATRR | (SEQ ID NO: 894) |
| 179 | +C + CY + TTTAGRDHAMAAAAYCCAGAVATR | (SEQ ID NO: 895) |
| 179 | +TAGAR + CCY + TTTAGRDHAMAAAAYCCAGAVATRR | (SEQ ID NO: 896) |
| 179 | +TAGAR + CCY + TTTAGRDHAMAAAAYCCAGAVATR | (SEQ ID NO: 897) |
| 179 | +TAGARC + CY + TTTAGRDHAMAAAAYCCAGAVATRR | (SEQ ID NO: 898) |
| 179 | +TAGARC + CY + TTTAGRDHAMAAAAYCCCAGAVATR | (SEQ ID NO: 899) |
| 179 | +TAGAR + C + CYTTTAGRDHAMAAAAYCCAGAVATRR | (SEQ ID NO: 900) |
| 179 | +TAGAR + C + CYTTTAGRDHAMAAAAYCCAGAVATR | (SEQ ID NO: 901) |
| 179 | +ARA + A + TYTTAGARCCYTTTAGRDHAMAAAAYCCAGAVATRR | (SEQ ID NO: 902) |
| 179 | A + ARA + A + TYTTAGARCCYTTTAGRDHAMAAAAYCCAGAVATR | (SEQ ID NO: 903) |
| 181 | CYTTTAGRDHAMAAAAYCCAGAVATRRTBATYT | (SEQ ID NO: 904) |
| 181 | CCYTTTAGRDHAMAAAAYCCAGAVATRRTBATYT | (SEQ ID NO: 905) |
| 181 | TTAGARCCYTTTAGRDHAMAAAAYCCAGAVATRRTBATYT | (SEQ ID NO: 906) |
| 181 | AGRDHAMAAAAYCCAGAVATRRTBATYT | (SEQ ID NO: 907) |
| 181 | TTTAGRDHAMAAAAYCCAGAVATRRTBATYT | (SEQ ID NO: 908) |
| 181 | ARAATYTTAGARCCYTTTAGRRHRMARAAYCCAGAVMTRRTTATC | (SEQ ID NO: 909) |
| 181 | CYTTTAGRDHAMAAAAYCCAGAVATRRTBATYT + N | (SEQ ID NO: 910) |
| 181 | CCYTTTAGRDHAMAAAAYCCAGAVATRRTBATYT + N | (SEQ ID NO: 911) |
| 181 | TTAGARCCYTTTAGRDHAMAAAAYCCAGAVATRRTBATYT + N | (SEQ ID NO: 912) |
| 181 | AGRDHAMAAAAYCCAGAVATRRTBATYT + N | (SEQ ID NO: 913) |
| 181 | TTTAGRDHAMAAAAYCCAGAVATRRTBATYT + N | (SEQ ID NO: 914) |
| 181 | ARAATYTTAGARCCYTTTAGRRHRMARAAYCCAGAVMTRRTTATC + N | (SEQ ID NO: 915) |
| 181 | +CY + TTTAGRDHAMAAA + AYCCAGAVATRRTBATYT | (SEQ ID NO: 916) |
| 181 | +CYTTT + AGRDHAMAAA + AYCCAGAVATRRTBATYT | (SEQ ID NO: 917) |
| 181 | +CY + TTT + AGRDHAMAAAAYCCAGAVATRRTBATYT | (SEQ ID NO: 918) |
| 181 | +C + CYTTT + AGRDHAMAAAAYCCAGAVATRRTBATYT | (SEQ ID NO: 919) |
| 181 | +CCY + TTT + AGRDHAMAAAAYCCAGAVATRRTBATYT | (SEQ ID NO: 920) |
| 181 | +C + CY + TTTAGRDHAMAAAAYCCAGAVATRRTBATYT | (SEQ ID NO: 921) |
| 181 | T + TAGAR + CCY + TTTAGRDHAMAAAAYCCAGAVATRRTBATYT | (SEQ ID NO: 922) |
| 181 | T + TAGARC + CY + TTTAGRDHAMAAAAYCCAGAVATRRTBATYT | (SEQ ID NO: 923) |
| 181 | +AGRDHAMAAA + AYCCAGAVATRRTBA + TYT | (SEQ ID NO: 924) |
| 181 | +AGRDHAMAAAAYCCAGAVA + TRRTBA + TYT | (SEQ ID NO: 925) |
| 181 | +AGRDHAMAAA + AYCCAGAVA + TRRTBATYT | (SEQ ID NO: 926) |
| 181 | +TTT + AGRDHAMAAAAYCCAGAVA + TRRTBATYT | (SEQ ID NO: 927) |
| 181 | +TTTAGRDHAMAAA + AYCCAGAVA + TRRTBATYT | (SEQ ID NO: 928) |
| 181 | +TTT + AGRDHAMAAA + AYCCAGAVATRRTBATYT | (SEQ ID NO: 929) |

TABLE 5 -continued

| | | |
|---|---|---|
| 181 | T + TAGAR + C + CYTTTAGRDHAMAAAAYCCAGAVATRRTBATYT | (SEQ ID NO: 930) |
| 184 | AYCCAGAVATRRTBATYTAYCAATAY | (SEQ ID NO: 931) |
| 184 | AGRDHAMAAAAYCCAGAVATRRTBATYTAYCAATAY | (SEQ ID NO: 932) |
| 184 | AYCCAGAVATRRTBATYTAYCAATAYRT | (SEQ ID NO: 933) |
| 184 | YTTTAGRDHAMAAAAYCCAGAVATRRTBATYTAYCAATAY | (SEQ ID NO: 934) |
| 184 | TTAGRDHAMAAAAYCCAGAVATRRTBATYTAYCAATAYRT | (SEQ ID NO: 935) |
| 184 | GARCCYTTTAGRRHRMARAAYCCAGAVMTRRTBATYTATCAATAC | (SEQ ID NO: 936) |
| 184 | AYCCAGAVATRRTBATYTAYCAATAY + N | (SEQ ID NO: 937) |
| 184 | AGRDHAMAAAAYCCAGAVATRRTBATYTAYCAATAY + N | (SEQ ID NO: 938) |
| 184 | AYCCAGAVATRRTBATYTAYCAATAYRT + N | (SEQ ID NO: 939) |
| 184 | YTTTAGRDHAMAAAAYCCAGAVATRRTBATYTAYCAATAY + N | (SEQ ID NO: 940) |
| 184 | TTAGRDHAMAAAAYCCAGAVATRRTBATYTAYCAATAYRT + N | (SEQ ID NO: 941) |
| 184 | GARCCYTTTAGRRHRMARAAYCCAGAVMTRRTBATYTATCAATAC + N | (SEQ ID NO: 942) |
| 184 | +AYCCAGAVA + TRRTBATY + TAYCAATAY | (SEQ ID NO: 943) |
| 184 | +AYCCAGAVATRRTBA + TY + TAYCAATAY | (SEQ ID NO: 944) |
| 184 | +AYCCAGAVA + TRRTBA + TYTAYCAATAY | (SEQ ID NO: 945) |
| 184 | +AGRDHAMAAA + AYCCAGAVATRRTBA + TYTAYCAATAY | (SEQ ID NO: 946) |
| 184 | +AYCCAGAVA + TRRTBATY + TAYCAATAYRT | (SEQ ID NO: 947) |
| 184 | +AGRDHAMAAAAYCCAGAVA + TRRTBA + TYTAYCAATAY | (SEQ ID NO: 948) |
| 184 | +AYCCAGAVATRRTBA + TY + TAYCAATAYRT | (SEQ ID NO: 949) |
| 184 | +AGRDHAMAAA + AYCCAGAVA + TRRTBATYTAYCAATAY | (SEQ ID NO: 950) |
| 184 | +AYCCAGAVA + TRRTBA + TYTAYCAATAYRT | (SEQ ID NO: 951) |
| 184 | Y + TTT + AGRDHAMAAAAYCCAGAVA + TRRTBATYTAYCAATAY | (SEQ ID NO: 952) |
| 184 | TT + AGRDHAMAAA + AYCCAGAVATRRTBA + TYTAYCAATAYRT | (SEQ ID NO: 953) |
| 184 | Y + TTTAGRDHAMAAA + AYCCAGAVA + TRRTBATYTAYCAATAY | (SEQ ID NO: 954) |
| 184 | TT + AGRDHAMAAAAYCCAGAVA + TRRTBA + TYTAYCAATAYRT | (SEQ ID NO: 955) |
| 184 | Y + TTT + AGRDHAMAAA + AYCCAGAVATRRTBATYTAYCAATAY | (SEQ ID NO: 956) |
| 184 | TT + AGRDHAMAAA + AYCCAGAVA + TRRTBATYTAYCAATAYRT | (SEQ ID NO: 957) |
| 188 | TYTAYCAATAYRTGGATGAYTTRT | (SEQ ID NO: 958) |
| 188 | TYTAYCAATAYRTGGATGAYTTR | (SEQ ID NO: 959) |
| 188 | TRRTBATYTAYCAATAYRTGGATGAYTTRT | (SEQ ID NO: 960) |
| 188 | TRRTBATYTAYCAATAYRTGGATGAYTTR | (SEQ ID NO: 961) |
| 188 | AAYCCAGAVATRRTBATYTAYCAATAYRTGGATGAYTTRT | (SEQ ID NO: 962) |
| 188 | AAAYCCAGAVATRRTBATYTAYCAATAYRTGGATGAYTTR | (SEQ ID NO: 963) |
| 188 | TAYCAATAYRTGGATGAYTTRT | (SEQ ID NO: 964) |
| 188 | TAYCAATAYRTGGATGAYTTR | (SEQ ID NO: 965) |
| 188 | RHRMARAAYCCAGAVMTRRTBATYTAYCARTAYATGGATGATTTG | (SEQ ID NO: 966) |
| 188 | TYTAYCAATAYRTGGATGAYTTRT + N | (SEQ ID NO: 967) |
| 188 | TYTAYCAATAYRTGGATGAYTTR + N | (SEQ ID NO: 968) |
| 188 | TRRTBATYTAYCAATAYRTGGATGAYTTRT + N | (SEQ ID NO: 969) |

TABLE 5 -continued

| | |
|---|---|
| 188 | TRRTBATYTAYCAATAYRTGGATGAYTTR + N (SEQ ID NO: 970) |
| 188 | AAYCCAGAVATRRTBATYTAYCAATAYRTGGATGAYTTRT + N (SEQ ID NO: 971) |
| 188 | AAAYCCAGAVATRRTBATYTAYCAATAYRTGGATGAYTTR + N (SEQ ID NO: 972) |
| 188 | TAYCAATAYRTGGATGAYTTRT + N (SEQ ID NO: 973) |
| 188 | TAYCAATAYRTGGATGAYTTR + N (SEQ ID NO: 974) |
| 188 | RHRMARAAYCCAGAVMTRRTBATYTAYCARTAYATGGATGATTTG + N (SEQ ID NO: 975) |
| 188 | +TY + TAYC + AATAYRTGGATGAYTTRT (SEQ ID NO: 976) |
| 188 | +TY + TAYC + AATAYRTGGATGAYTTR (SEQ ID NO: 977) |
| 188 | +TYTAY + C + AATAYRTGGATGAYTTRT (SEQ ID NO: 978) |
| 188 | TYTAY + C + AATAYRTGGATGAYTTR (SEQ ID NO: 979) |
| 188 | +TY + TAY + CAATAYRTGGATGAYTTRT (SEQ ID NO: 980) |
| 188 | +TY + TAY + CAATAYRTGGATGAYTTR (SEQ ID NO: 981) |
| 188 | +TRRTBA + TYTAY + CAATAYRTGGATGAYTTRT (SEQ ID NO: 982) |
| 188 | +TRRTBA + TYTAY + CAATAYRTGGATGAYTTR (SEQ ID NO: 983) |
| 188 | +TRRTBATY + TAY + CAATAYRTGGATGAYTTRT (SEQ ID NO: 984) |
| 188 | +TRRTBATY + TAY + CAATAYRTGGATGAYTTR (SEQ ID NO: 985) |
| 188 | +TRRTBA + TY + TAYCAATAYRTGGATGAYTTRT (SEQ ID NO: 986) |
| 188 | +TRRTBA + TY + TAYCAATAYRTGGATGAYTTR (SEQ ID NO: 987) |
| 188 | A + AYCCAGAVA + TRRTBATY + TAYCAATAYRTGGATGAYTTRT (SEQ ID NO: 988) |
| 188 | AA + AYCCAGAVA + TRRTBATY + TAYCAATAYRTGGATGAYTTR (SEQ ID NO: 989) |
| 188 | A + AYCCAGAVATRRTBA + TY + TAYCAATAYRTGGATGAYTTRT (SEQ ID NO: 990) |
| 188 | AA + AYCCAGAVATRRTBA + TY + TAYCAATAYRTGGATGAYTTR (SEQ ID NO: 991) |
| 188 | +TAY + CAA + TAYRTGGATGAYTTRT (SEQ ID NO: 992) |
| 188 | +TAY + CAA + TAYRTGGATGAYTTR (SEQ ID NO: 993) |
| 188 | +TAYC + AA + TAYRTGGATGAYTTRT (SEQ ID NO: 994) |
| 188 | +TARC + AA + TAYRTGGATGAYTTR (SEQ ID NO: 995) |
| 188 | +TAY + C + AATAYRTGGATGAYTTRT (SEQ ID NO: 996) |
| 188 | +TAY + C + AATAYRTGGATGAYTTR (SEQ ID NO: 997) |
| 188 | A + AYCCAGAVA + TRRTBA + TYTAYCAATAYRTGGATGAYTTRT (SEQ ID NO: 998) |
| 188 | AA + AYCCAGAVA + TRRTBA + TYTAYCAATAYRTGGATGAYTTR (SEQ ID NO: 999) |
| 190 | TAYCAATAYRTGGATGAYTTRTATGTAG (SEQ ID NO: 1000) |
| 190 | TAYCAATAYRTGGATGAYTTRTATGTA (SEQ ID NO: 1001) |
| 190 | TYTAYCAATAYRTGGATGAYTTRTATGTAG (SEQ ID NO: 1002) |
| 190 | TYTAYCAATAYRTGGATGAYTTRTATGTA (SEQ ID NO: 1003) |
| 190 | GAVATRRTBATYTAYCAATAYRTGGATGAYTTRTATGTAG (SEQ ID NO: 1004) |
| 190 | AGAVATRRTBATYTAYCAATAYRTGGATGAYTTRTATGTA (SEQ ID NO: 1005) |
| 190 | TAYRTGGATGAYTTRTATGTAG (SEQ ID NO: 1006) |
| 190 | TAYRTGGATGAYTTRTATGTA (SEQ ID NO: 1007) |
| 190 | AATAYRTGGATGAYTTRTATGTAG (SEQ ID NO: 1008) |

TABLE 5 -continued

| | |
|---|---|
| 190 | AATAYRTGGATGAYTTRTATGTA (SEQ ID NO: 1009) |
| 190 | CAATAYRTGGATGAYTTRTATGTAG (SEQ ID NO: 1010) |
| 190 | CAATAYRTGGATGAYTTRTATGTA (SEQ ID NO: 1011) |
| 190 | AAYCCAGAVMTRRTBATYTAYCARTAYATGGATGAYTTRTATGTA (SEQ ID NO: 1012) |
| 190 | TAYCAATAYRTGGATGAYTTRTATGTAG + N (SEQ ID NO: 1013) |
| 190 | TAYCAATAYRTGGATGAYTTRTATGTA + N (SEQ ID NO: 1014) |
| 190 | TYTAYCAATAYRTGGATGAYTTRTATGTAG + N (SEQ ID NO: 1015) |
| 190 | TYTAYCAATAYRTGGATGAYTTRTATGTA + N (SEQ ID NO: 1016) |
| 190 | GAVATRRTBATYTAYCAATAYRTGGATGAYTTRTATGTAG + N (SEQ ID NO: 1017) |
| 190 | AGAVATRRTBATYTAYCAATAYRTGGATGAYTTRTATGTA + N (SEQ ID NO: 1018) |
| 190 | TAYRTGGATGAYTTRTATGTAG + N (SEQ ID NO: 1019) |
| 190 | TAYRTGGATGAYTTRTATGTA + N (SEQ ID NO: 1020) |
| 190 | AATAYRTGGATGAYTTRTATGTAG + N (SEQ ID NO: 1021) |
| 190 | AATAYRTGGATGAYTTRTATGTA + N (SEQ ID NO: 1022) |
| 190 | CAATAYRTGGATGAYTTRTATGTAG + N (SEQ ID NO: 1023) |
| 190 | CAATAYRTGGATGAYTTRTATGTA + N (SEQ ID NO: 1024) |
| 190 | AAYCCAGAVMTRRTBATYTAYCARTAYATGGATGAYTTRTATGTA + N (SEQ ID NO: 1025) |
| 190 | +TAY + CAA + TAYRTGGATGAYTTRTATGTAG (SEQ ID NO: 1026) |
| 190 | +TAY + CAA + TAYRTGGATGAYTTRTATGTA (SEQ ID NO: 1027) |
| 190 | +TAYC + AA + TAYRTGGATGAYTTRTATGTAG (SEQ ID NO: 1028) |
| 190 | +TAYC + AA + TAYRTGGATGAYTTRTATGTA (SEQ ID NO: 1029) |
| 190 | +TAY + C + AATAYRTGGATGAYTTRTATGTAG (SEQ ID NO: 1030) |
| 190 | +TAY + C + AATAYRTGGATGAYTTRTATGTA (SEQ ID NO: 1031) |
| 190 | +TY + TAYC + AATAYRTGGATGAYTTRTATGTAG (SEQ ID NO: 1032) |
| 190 | +TY + TAYC + AATAYRTGGATGAYTTRTATGTA (SEQ ID NO: 1033) |
| 190 | +TYTAY + C + AATAYRTGGATGAYTTRTATGTAG (SEQ ID NO: 1034) |
| 190 | +TYTAY + C + AATAYRTGGATGAYTTRTATGTA (SEQ ID NO: 1035) |
| 190 | +TY + TAY + CAATAYRTGGATGAYTTRTATGTAG (SEQ ID NO: 1036) |
| 190 | +TY + TAY + CAATAYRTGGATGAYTTRTATGTA (SEQ ID NO: 1037) |
| 190 | GAVA + TRRTBA + TYTAY + CAATAYRTGGATGAYTTRTATGTAG (SEQ ID NO: 1038) |
| 190 | AGAVA + TRRTBA + TYTAY + CAATAYRTGGATGAYTTRTATGTA (SEQ ID NO: 1039) |
| 190 | GAVA + TRRTBATY + TAY + CAATAYRTGGATGAYTTRTATGTAG (SEQ ID NO: 1040) |
| 190 | AGAVA + TRRTBATY + TAY + CAATAYRTGGATGAYTTRTATGTA (SEQ ID NO: 1041) |
| 190 | +T + AYRTG + GATGAYTTRTATGTAG (SEQ ID NO: 1042) |
| 190 | +T + AYRTG + GATGAYTTRTATGTA (SEQ ID NO: 1043) |
| 190 | +TAYR + TG + GATGAYTTRTATGTAG (SEQ ID NO: 1044) |
| 190 | +TAYR - TG + GATGAYTTRTATGTA (SEQ ID NO: 1045) |

TABLE 5 -continued

| | | |
|---|---|---|
| 190 | +T + AYR + TGGATGAYTTRTATGTAG (SEQ ID NO: 1046) | |
| 190 | +T + AYR + TGGATGAYTTRTATGTA (SEQ ID NO: 1047) | |
| 190 | +AA + TAYR + TGGATGAYTTRTATGTAG (SEQ ID NO: 1048) | |
| 190 | +AA + TAYR + TGGATGAYTTRTATGTA (SEQ ID NO: 1049) | |
| 190 | +AAT + AYR + TGGATGAYTTRTATGTAG (SEQ ID NO: 1050) | |
| 190 | +AAT + AYR + TGGATGAYTTRTATGTA (SEQ ID NO: 1051) | |
| 190 | +AA + T + AYRTGGATGAYTTRTATGTAG (SEQ ID NO: 1052) | |
| 190 | +AA + T + AYRTGGATGAYTTRTATGTA (SEQ ID NO: 1053) | |
| 190 | +C + AAT + AYRTGGATGAYTTRTATGTAG (SEQ ID NO: 1054) | |
| 190 | +C + AAT + AYRTGGATGAYTTRTATGTA (SEQ ID NO: 1055) | |
| 190 | +CAA + T + AYRTGGATGAYTTRTATGTAG (SEQ ID NO: 1056) | |
| 190 | +CAA + T + AYRTGGATGAYTTRTATGTA (SEQ ID NO: 1057) | |
| 190 | +C + AA + TAYRTGGATGAYTTRTATGTAG (SEQ ID NO: 1058) | |
| 190 | +C + AA + TAYRTGGATGAYTTRTATGTA (SEQ ID NO: 1059) | |
| 190 | GAVA + TRRTBA + TY + TAYCAATAYRTGGATGAYTTRTATGTAG (SEQ ID NO: 1060) | |
| 190 | AGAVA + TRRTBA + TY + TAYCAATAYRTGGATGAYTTRTATGTA (SEQ ID NO: 1061) | |
| 210 | AGARYAAAARTAGARGARYTRAGRVMDCAYYTRY (SEQ ID NO: 1062) | |
| 210 | AYAGARYAAAARTAGARGARYTRAGRVMDCAYYTRY (SEQ ID NO: 1063) | |
| 210 | CARCAYAGARYAAAARTAGARGARYTRAGRVMDCAYYTRY (SEQ ID NO: 1064) | |
| 210 | TAGARGARYTRAGRVMDCAYYTRY (SEQ ID NO: 1065) | |
| 210 | AAARTAGARGARYTRAGRVMDCAYYTRY (SEQ ID NO: 1066) | |
| 210 | GARYAAAARTAGARGARYTRAGRVMDCAYYTRY (SEQ ID NO: 1067) | |
| 210 | ATAGRRCARCAYAGARYAAAARTAGARGARYTRAGRVMDCATCTG (SEQ ID NO: 1068) | |
| 210 | AGARYAAAARTAGARGARYTRAGRVMDCAYYTRY + N (SEQ ID NO: 1069) | |
| 210 | AYAGARYAAAARTAGARGARYTRAGRVMDCAYYTRY + N (SEQ ID NO: 1070) | |
| 210 | CARCAYAGARYAAAARTAGARGARYTRAGRVMDCAYYTRY + N (SEQ ID NO: 1071) | |
| 210 | TAGARGARYTRAGRVMDCAYYTRY + N (SEQ ID NO: 1072) | |
| 210 | AAARTAGARGARYTRAGRVMDCAYYTRY + N (SEQ ID NO: 1073) | |
| 210 | GARYAAAARTAGARGARYTRAGRVMDCAYYTRY + N (SEQ ID NO: 1074) | |
| 210 | ATAGRRCARCAYAGARYAAAARTAGARGARYTRAGRVMDCATCTG + N (SEQ ID NO: 1075) | |
| 210 | +A + GARYAAAAR + TAGARGARYTRAGRVMDCAYYTRY (SEQ ID NO: 1076) | |
| 210 | +AGARYA + AAAR + TAGARGARYTRAGRVMDCAYYTRY (SEQ ID NO: 1077) | |
| 210 | +A + GARYA + AAARTAGARGARYTRAGRVMDCAYYTRY (SEQ ID NO: 1078) | |
| 210 | +AY + AGARYA + AAARTAGARGARYTRAGRVMDCAYYTRY (SEQ ID NO: 1079) | |
| 210 | +AYA + GARYA + AAARTAGARGARYTRAGRVMDCAYYTRY (SEQ ID NO: 1080) | |
| 210 | +AY + A + GARYAAAARTAGARGARYTRAGRVMDCAYYTRY (SEQ ID NO: 1081) | |
| 210 | CAR + C + AYA + GARYAAAARTAGARGARYTRAGRVMDCAYYTRY (SEQ ID NO: 1082) | |

TABLE 5 -continued

| | |
|---|---|
| 210 | CAR + CAY + A + GARYAAAARTAGARGARYTRAGRVMDCAYYTRY (SEQ ID NO: 1083) |
| 210 | +TAG + ARGARY + TRAGRVMDCAYYTRY (SEQ ID NO: 1084) |
| 210 | +TAGARG + ARY + TRAGRVMDCAYYTRY (SEQ ID NO: 1085) |
| 210 | +TAG + ARG + ARYTRAGRVMDCAYYTRY (SEQ ID NO: 1086) |
| 210 | +AAAR + TAGARG + ARYTRAGRVMDCAYYTRY (SEQ ID NO: 1087) |
| 210 | +AAARTAG + ARG + ARYTRAGRVMDCAYYTRY (SEQ ID NO: 1088) |
| 210 | +AAAR + TAG + ARGARYTRAGRVMDCAYYTRY (SEQ ID NO: 1089) |
| 210 | +GARYA + AAARTAG + ARGARYTRAGRVMDCAYYTRY (SEQ ID NO: 1090) |
| 210 | +GARYAAAAR + TAG + ARGARYTRAGRVMDCAYYTRY (SEQ ID NO: 1091) |
| 210 | +GARYA + AAAR + TAGARGARYTRAGRVMDCAYYTRY (SEQ ID NO: 1092) |
| 210 | CAR + C + AY + AGARYAAAARTAGARGARYTRAGRVMDCAYYTRY (SEQ ID NO: 1093) |
| 215 | ARYTRAGRVMDCAYYTRYTRARVTGGGGRYTYW (SEQ ID NO: 1094) |
| 215 | ARGARYTRAGRVMDCAYYTRYTRARVTGGGGRYTYW (SEQ ID NO: 1095) |
| 215 | RTAGARGARYTRAGRVMDCAYYTRYTRARVTGGGGRYTYW (SEQ ID NO: 1096) |
| 215 | GRVMDCAYYTRYTRARVTGGGGRYTYW (SEQ ID NO: 1097) |
| 215 | AGRVMDCAYYTRYTRARVTGGGGRYTYW (SEQ ID NO: 1098) |
| 215 | TRAGRVMDCAYYTRYTRARVTGGGGRYTYW (SEQ ID NO: 1099) |
| 215 | RYAAAARTAGARGARYTRAGRVMDCAYYTRYTRARVTGGGGATTT (SEQ ID NO: 1100) |
| 215 | ARYTRAGRVMDCAYYTRYTRARVTGGGGRYTYW + N (SEQ ID NO: 1101) |
| 215 | ARGARYTRAGRVMDCAYYTRYTRARVTGGGGRYTYW + N (SEQ ID NO: 1102) |
| 215 | RTAGARGARYTRAGRVMDCAYYTRYTRARVTGGGGRYTYW + N (SEQ ID NO: 1103) |
| 215 | GRVMDCAYYTRYTRARVTGGGGRYTYW + N (SEQ ID NO: 1104) |
| 215 | AGRVMDCAYYTRYTRARVTGGGGRYTYW + N (SEQ ID NO: 1105) |
| 215 | TRAGRVMDCAYYTRYTRARVTGGGGRYTYW + N (SEQ ID NO: 1106) |
| 215 | RYAAAARTAGARGARYTRAGRVMDCAYYTRYTRARVTGGGGATTT + N (SEQ ID NO: 1107) |
| 215 | +ARY + TRA + GRVMDCAYYTRYTRARVTGGGGRYTYW (SEQ ID NO: 1108) |
| 215 | +ARYTR + A + GRVMDCAYYTRYTRARVTGGGGRYTYW (SEQ ID NO: 1109) |
| 215 | +ARY + TR + AGRVMDCAYYTRYTRARVTGGGGRYTYW (SEQ ID NO: 1110) |
| 215 | +ARG + ARYTR + AGRVMDCAYYTRYTRARVTGGGGRYTYW (SEQ ID NO: 1111) |
| 215 | +ARGARY + TR + AGRVMDCAYYTRYTRARVTGGGGRYTYW (SEQ ID NO: 1112) |
| 215 | +ARG + ARY + TRAGRVMDCAYYTRYTRARVTGGGGRYTYW (SEQ ID NO: 1113) |
| 215 | R + TAG + ARGARY + TRAGRVMDCAYYTRYTRARVTGGGGRYTYW (SEQ ID NO: 1114) |
| 215 | R + TAGARG + ARY + TRAGRVMDCAYYTRYTRARVTGGGGRYTYW (SEQ ID NO: 1115) |
| 215 | +GRVMDC + AYYTRYTRARV + TGGGGRYTYW (SEQ ID NO: 1116) |
| 215 | +GRVMDCAYY + TRYTRARV + TGGGGRYTYW (SEQ ID NO: 1117) |
| 215 | +GRVMDC + AYY + TRYTRARVTGGGGRYTYW (SEQ ID NO: 1118) |
| 215 | +A + GRVMDCAYY + TRYTRARVTGGGGRYTYW (SEQ ID NO: 1119) |
| 215 | +AGRVMDC + AYY + TRYTRARVTGGGGRYTYW (SEQ ID NO: 1120) |

TABLE 5 -continued

| | |
|---|---|
| 215 | +A + GRVMDC + AYYTRYTRARVTGGGGRYTYW (SEQ ID NO: 1121) |
| 215 | +TR + AGRMVDC + AYYTRYTRARVTGGGGRYTYW (SEQ ID NO: 1122) |
| 215 | +TRA + GRVMDC + AYYTRYTRARVTGGGGRYTYW (SEQ ID NO: 1123) |
| 215 | +TR + A + GRVMDCAYYTRYTRARVTGGGGRYTYW (SEQ ID NO: 1124) |
| 215 | R + TAG + ARG + ARYTRAGRVMDCAYYTRYTRARVTGGGGRYTYW (SEQ ID NO: 1125) |
| 219 | AYYTRYTRARVTGGGGRYTYWCYACACCAGAY (SEQ ID NO: 1126) |
| 219 | TRYTRARVTGGGGRYTYWCYACACCAGAYAA (SEQ ID NO: 1127) |
| 219 | AYYTRYTRARVTGGGGRYTYWCYACACCAGAYA (SEQ ID NO: 1128) |
| 219 | GRVMDCAYYTRYTRARVTGGGGRYTYWCYACACCAGAY (SEQ ID NO: 1129) |
| 219 | AYYTRYTRARVTGGGGRYTYWCYACACCAGAYAA (SEQ ID NO: 1130) |
| 219 | GRVMDCAYYTRYTRARVTGGGGRYTYWCYACACCAGAYA (SEQ ID NO: 1131) |
| 219 | RAGRVMDCAYYTRYTRARVTGGGGRYTYWCYACACCAGAY (SEQ ID NO: 1132) |
| 219 | GRVMDCAYYTRYTRARVTGGGGRYTYWCYACACCAGAYAA (SEQ ID NO: 1133) |
| 219 | AGRVMDCAYYTRYTRARVTGGGGRYTYWCYACACCAGAYA (SEQ ID NO: 1134) |
| 219 | GGGRYTYWCYACACCAGAYAA (SEQ ID NO: 1135) |
| 219 | GGGRYTYWCYACACCAGAYA (SEQ ID NO: 1136) |
| 219 | TGGGGRYTYWCYACACCAGAY (SEQ ID NO: 1137) |
| 219 | GGGGRYTYWCYACACCAGAYAA (SEQ ID NO: 1138) |
| 219 | TGGGGRYTYWCYACACCAGAYA (SEQ ID NO: 1139) |
| 219 | TRYTRARVTGGGGRYTYWCYACACCAGAY (SEQ ID NO: 1140) |
| 219 | TGGGGRYTYWCYACACCAGAYAA (SEQ ID NO: 1141) |
| 219 | TRYTRARVTGGGGRYTYWCYACACCAGAYA (SEQ ID NO: 1142) |
| 219 | GARYTRAGRVMDCAYYTRYTRARVTGGGGRYTYWMYACMCCAGAC (SEQ ID NO: 1143) |
| 219 | AYYTRYTRARVTGGGGRYTYWCYACACCAGAY + N (SEQ ID NO: 1144) |
| 219 | TRYTRARVTGGGGRYTYWCYACACCAGAYAA + N (SEQ ID NO: 1145) |
| 219 | AYYTRYTRARVTGGGGRYTYWCYACACCAGAYA + N (SEQ ID NO: 1146) |
| 219 | GRVMDCAYYTRYTRARVTGGGGRYTYWCYACACCAGAY + N (SEQ ID NO: 1147) |
| 219 | AYYTRYTRARVTGGGGRYTYWCYACACCAGAYAA + N (SEQ ID NO: 1148) |
| 219 | GRVMDCAYYTRYTRARVTGGGGRYTYWCYACACCAGAYA + N (SEQ ID NO: 1149) |
| 219 | RAGRVMDCAYYTRYTRARVTGGGGRYTYWCYACACCAGAY + N (SEQ ID NO: 1150) |
| 219 | GRVMDCAYYTRYTRARVTGGGGRYTYWCYACACCAGAYAA + N (SEQ ID NO: 1151) |
| 219 | AGRVMDCAYYTRYTRARVTGGGGRYTYWCYACACCAGAYA + N (SEQ ID NO: 1152) |
| 219 | GGGRYTYWCYACACCAGAYAA + N (SEQ ID NO: 1153) |
| 219 | GGGGRYTYWCYACACCAGAYA + N (SEQ ID NO: 1154) |
| 219 | TGGGGRYTYWCYACACCAGAY + N (SEQ ID NO: 1155) |

TABLE 5 -continued

| | |
|---|---|
| 219 | GGGGRYTYWCYACACCAGAYAA + N (SEQ ID NO: 1156) |
| 219 | TGGGGRYTYWCYACACCAGAYA + N (SEQ ID NO: 1157) |
| 219 | TRYTRARVTGGGGRYTYWCYACACCAGAY + N (SEQ ID NO: 1158) |
| 219 | TGGGGRYTYWCYACACCAGAYAA + N (SEQ ID NO: 1159) |
| 219 | TRYTRARVTGGGGRYTYWCYACACCAGAYA + N (SEQ ID NO: 1160) |
| 219 | GARYTRAGRVMDCAYYTRYTRARVTGGGGRYTYWMYACMCCAGAC + N (SEQ ID NO: 1161) |
| 219 | +AYY + TRYTRARVT + GGGGRYTYWCYACACCAGAY (SEQ ID NO: 1162) |
| 219 | +TRYTRARV + TG + GGGRYTYWCYACACCAGAYAA (SEQ ID NO: 1163) |
| 219 | +AYY + TRYTRARVT + GGGGRYTYWCYACACCAGAYA (SEQ ID NO: 1164) |
| 219 | +AYYTRYTRARV + T + GGGGRYTYWCYACACCAGAY (SEQ ID NO: 1165) |
| 219 | +TRYTRARVT + G + GGGGRYTYWCYACACCAGAYAA (SEQ ID NO: 1166) |
| 219 | +AYYTRYTRARV + T + GGGGRYTYWCYACACCAGAYA (SEQ ID NO: 1167) |
| 219 | +AYY + TRYTRARV + TGGGGRYTYWCYACACCAGAY (SEQ ID NO: 1168) |
| 219 | +TRYTRARV + T + GGGGRYTYWCYACACCAGAYAA (SEQ ID NO: 1169) |
| 219 | +AYY + TRYTRARV + TGGGGRYTYWCYACACCAGAYA (SEQ ID NO: 1170) |
| 219 | +GRVMDC + AYYTRYTRARV + TGGGGRYTYWCYACACCAGAY (SEQ ID NO: 1171) |
| 219 | +AYY + TRYTRARVT + GGGGRYTYWCYACACCAGAYAA (SEQ ID NO: 1172) |
| 219 | +GRVMDC + AYYTRYTRARV + TGGGGRYTYWCYACACCAGAYA (SEQ ID NO: 1173) |
| 219 | +GRVMDCAYY + TRYTRARV + TGGGGRYTYWCYACACCAGAY (SEQ ID NO: 1174) |
| 219 | +AYYTRYTRARV + T + GGGGRYTYWCYACACCAGAYAA (SEQ ID NO: 1175) |
| 219 | +GRVMDCAYY + TRYTRARV + TGGGGRYTYWCYACACCAGAYA (SEQ ID NO: 1176) |
| 219 | +GRVMDC + AYY + TRYTRARVTGGGGRYTYWCYACACCAGAY (SEQ ID NO: 1177) |
| 219 | +AYY + TRYTRARV + TGGGGRYTYWCYACACCAGAYAA (SEQ ID NO: 1178) |
| 219 | +GRVMDC + AYY + TRYTRARVTGGGGRYTYWCYACACCAGAYA (SEQ ID NO: 1179) |
| 219 | R + A + GRVMDCAYY + TRYTRARVTGGGGRYTYWCYACACCAGAY (SEQ ID NO: 1180) |
| 219 | +GRVMDC + AYYTRYTRARV + TGGGGRYTYWCYACACCAGAYAA (SEQ ID NO: 1181) |
| 219 | +A + GRVMDCAYY + TRYTRARVTGGGGRYTYWCYACACCAGAYA (SEQ ID NO: 1182) |
| 219 | R + AGRVMDC + AYY + TRYTRARVTGGGGRYTYWCYACACCAGAY (SEQ ID NO: 1183) |
| 219 | +GRVMDCAYY + TRYTRARV + TGGGGRYTYWCYACACCAGAYAA (SEQ ID NO: 1184) |
| 219 | +AGRVMDC + AYY + TRYTRARVTGGGGRYTYWCYACACCAGAYA (SEQ ID NO: 1185) |
| 219 | +G + GGRY + TYWCYACACCAGAYAA (SEQ ID NO: 1186) |
| 219 | +G + GG + GRYTYWCYACACCAGAYA (SEQ ID NO: 1187) |
| 219 | +GG + GRY + TYWCYACACCAGAYAA (SEQ ID NO: 1188) |
| 219 | +GG + G + GRYTYWCYACACCAGAYA (SEQ ID NO: 1189) |
| 219 | +G + G + GRYTYWCYACACCAGAYAA (SEQ ID NO: 1190) |
| 219 | +G + G + GGRYTYWCYACACCAGAYA (SEQ ID NO: 1191) |
| 219 | +T + GG + GGRYTYWCYACACCAGAY (SEQ ID NO: 1192) |
| 219 | +G + GG + GRYTYWCYACACCAGAYAA (SEQ ID NO: 1193) |
| 219 | +T + GG + GGRYTYWCYACACCAGAYA (SEQ ID NO: 1194) |

TABLE 5 -continued

| | | |
|---|---|---|
| 219 | +TG + G + GGRYTYWCYACACCAGAY | (SEQ ID NO: 1195) |
| 219 | +GG + G + GRYTYWCYACACCAGAYAA | (SEQ ID NO: 1196) |
| 219 | +TG + G + GGRYTYWCYACACCAGAYA | (SEQ ID NO: 1197) |
| 219 | +T + G + GGGRYTYWCYACACCAGAY | (SEQ ID NO: 1198) |
| 219 | +G + G + GGRYTYWCYACACCAGAYAA | (SEQ ID NO: 1199) |
| 219 | +T + G + GGGRYTYWCYACACCAGAYA | (SEQ ID NO: 1200) |
| 219 | +TRYTRARV + TG + GGGRYTYWCYACACCAGAY | (SEQ ID NO: 1201) |
| 219 | +T + GG + GGRYTYWCYACACCAGAYAA | (SEQ ID NO: 1202) |
| 219 | +TRYTRARV + TG + GGGRYTYWCYACACCAGAYA | (SEQ ID NO: 1203) |
| 219 | +TRYTRARVT + G + GGGRYTYWCYACACCAGAY | (SEQ ID NO: 1204) |
| 219 | +TG + G + GGRYTYWCYACACCAGAYAA | (SEQ ID NO: 1205) |
| 219 | +TRYTRARVT + G + GGGRYTYWCYACACCAGAYA | (SEQ ID NO: 1206) |
| 219 | +TRYTRARV + T + GGGGRYTYWCYACACCAGAY | (SEQ ID NO: 1207) |
| 219 | +T + G + GGGRYTYWCYACACCAGAYAA | (SEQ ID NO: 1208) |
| 219 | +TRYTRARV + T + GGGGRYTYWCYACACCAGAYA | (SEQ ID NO: 1209) |
| 219 | R + A + GRVMDC + AYYTRYTRARVTGGGGRYTYWCYACACCAGAY | (SEQ ID NO: 1210) |
| 219 | +GRVMDC + AYY + TRYTRARVTGGGGRYTYWCYACACCAGAYAA | (SEQ ID NO: 1211) |
| 219 | +A + GRVMDC + AYYTRYTRARVTGGGGRYTYWCYACACCAGAYA | (SEQ ID NO: 1212) |
| 225 | GGGRYTYWCYACACCAGAYAARAARCATCARAARGAAC | (SEQ ID NO: 1213) |
| 225 | GGGGRYTYWCYACACCAGAYAARAARCATCARAARGAAC | (SEQ ID NO: 1214) |
| 225 | TGGGGRYTYWCYACACCAGAYAARAARCATCARAARGAAC | (SEQ ID NO: 1215) |
| 225 | TYWCYACACCAGAYAARAARCATCARAARGAAC | (SEQ ID NO: 1216) |
| 225 | GRYTYWCYACACCAGAYAARAARCATCARAARGAAC | (SEQ ID NO: 1217) |
| 225 | GGRYTYWCYACACCAGAYAARAARCATCARAARGAAC | (SEQ ID NO: 1218) |
| 225 | YTRARVTGGGGRYTYWMYACMCCAGAYAARAARCATCARAAAGAA | (SEQ ID NO: 1219) |
| 225 | GGGRYTYWCYACACCAGAYAARAARCATCARAARGAAC + N | (SEQ ID NO: 1220) |
| 225 | GGGGRYTYWCYACACCAGAYAARAARCATCARAARGAAC + N | (SEQ ID NO: 1221) |
| 225 | TGGGGRYTYWCYACACCAGAYAARAARCATCARAARGAAC + N | (SEQ ID NO: 1222) |
| 225 | TYWCYACACCAGAYAARAARCATCARAARGAAC + N | (SEQ ID NO: 1223) |
| 225 | GRYTYWCYACACCAGAYAARAARCATCARAARGAAC + N | (SEQ ID NO: 1224) |
| 225 | GGRYTYWCYACACCAGAYAARAARCATCARAARGAAC + N | (SEQ ID NO: 1225) |
| 225 | YTRARVTGGGGRYTYWMYACMCCAGAYAARAARCATCARAAAGAA + N | (SEQ ID NO: 1226) |
| 225 | +G + GGRY + TYWCYACACCAGAYAARAARCATCARAARGAAC | (SEQ ID NO: 1227) |
| 225 | +GG + GRY + TYWCYACACCAGAYAARAARCATCARAARGAAC | (SEQ ID NO: 1228) |
| 225 | +G + G + GRYTYWCYACACCAGAYAARAARCATCARAARGAAC | (SEQ ID NO: 1229) |
| 225 | +G + GG + GRYTYWCYACACCAGAYAARAARCATCARAARGAAC | (SEQ ID NO: 1230) |
| 225 | +GG + G + GRYTYWCYACACCAGAYAARAARCATCARAARGAAC | (SEQ ID NO: 1231) |
| 225 | +G + G + GGRYTYWCYACACCAGAYAARAARCATCARAARGAAC | (SEQ ID NO: 1232) |
| 225 | +T + GG + GGRYTYWCYACACCAGAYAARAARCATCARAARGAAC | (SEQ ID NO: 1233) |

TABLE 5 -continued

| 225 | +TG + G + GGRYTYWCYACACCAGAYAARAARCATCARAARGAAC (SEQ ID NO: 1234) |
| --- | --- |
| 225 | +TYWCY + ACA + CCAGAYAARAARCATCARAARGAAC (SEQ ID NO: 1235) |
| 225 | +TYWCYA + CA + CCAGAYAARAARCATCARAARGAAC (SEQ ID NO: 1236) |
| 225 | +TYWCY + A + CACCAGAYAARAARCATCARAARGAAC (SEQ ID NO: 1237) |
| 225 | +GRY + TYWCYA + CACCAGAYAARAARCATCARAARGAAC (SEQ ID NO: 1238) |
| 225 | +GRYTYWCY + A + CACCAGAYAARAARCATCARAARGAAC (SEQ ID NO: 1239) |
| 225 | +GRY + TYWCY + ACACCAGAYAARAARCATCARAARGAAC (SEQ ID NO: 1240) |
| 225 | +G + GRYTYWCY + ACACCAGAYAARAARCATCARAARGAAC (SEQ ID NO: 1241) |
| 225 | +GGRY + TYWCY + ACACCAGAYAARAARCATCARAARGAAC (SEQ ID NO: 1242) |
| 225 | +G + GRY + TYWCYACACCAGAYAARAARCATCARAARGAAC (SEQ ID NO: 1243) |
| 225 | +T + G + GGGRYTYWCYACACCAGAYAARAARCATCARAARGAAAC (SEQ ID NO: 1244) |
| 227 | CACCAGAYAARAARCATCARAARGAACCYCCA (SEQ ID NO: 1245) |
| 227 | CACCAGAYAARAARCATCARAARGAACCYCCAT (SEQ ID NO: 1246) |
| 227 | ACACCAGAYAARAARCATCARAARGAACCYCCA (SEQ ID NO: 1247) |
| 227 | ACACCAGAYAARAARCATCARAARGAACCYCCAT (SEQ ID NO: 1248) |
| 227 | RYTYWCYACACCAGAYAARAARCATCARAARGAACCYCCA (SEQ ID NO: 1249) |
| 227 | YTYWCYACACCAGAYAARAARCATCARAARGAACCYCCAT (SEQ ID NO: 1250) |
| 227 | GAYAARAARCATCARAARGAACCYCCA (SEQ ID NO: 1251) |
| 227 | GAYAARAARCATCARAARGAACCYCCAT (SEQ ID NO: 1252) |
| 227 | CAGAYAARAARCATCARAARGAACCYCCA (SEQ ID NO: 1253) |
| 227 | CAGAYAARAARCATCARAARGAACCYCCAT (SEQ ID NO: 1254) |
| 227 | CCAGAYAARAARCATCARAARGAACCYCCA (SEQ ID NO: 1255) |
| 227 | CCAGAYAARAARCATCARAARGAACCYCCAT (SEQ ID NO: 1256) |
| 227 | TGGGGRYTYWMYACMCCAGAYAARAARCATCARAARGAACCTCCA (SEQ ID NO: 1257) |
| 227 | CACCAGAYAARAARCATCARAARGAACCYCCA + N (SEQ ID NO: 1258) |
| 227 | CACCAGAYAARAARCATCARAARGAACCYCCAT + N (SEQ ID NO: 1259) |
| 227 | ACACCAGAYAARAARCATCARAARGAACCYCCA + N (SEQ ID NO: 1260) |
| 227 | ACACCAGAYAARAARCATCARAARGAACCYCCAT + N (SEQ ID NO:1261) |
| 227 | RYTYWCYACACCAGAYAARAARCATCARAARGAACCYCCA + N (SEQ ID NO: 1262) |
| 227 | YTYWCYACACCAGAYAARAARCATCARAARGAACCYCCAT + N (SEQ ID NO: 1263) |
| 227 | GAYAARAARCATCARAARGAACCYCCA + N (SEQ ID NO: 1264) |
| 227 | GAYAARAARCATCARAARGAACCYCCAT + N (SEQ ID NO: 1265) |
| 227 | CAGAYAARAARCATCARAARGAACCYCCA + N (SEQ ID NO: 1266) |
| 227 | CAGAYAARAARCATCARAARGAACCYCCAT + N (SEQ ID NO: 1267) |
| 227 | CCAGAYAARAARCATCARAARGAACCYCCA + N (SEQ ID NO: 1268) |
| 227 | CCAGAYAARAARCATCARAARGAACCYCCAT + N (SEQ ID NO: 1269) |
| 227 | TGGGGRYTYWMYACMCCAGAYAARAARCATCARAARGAACCTCCA + N (SEQ ID NO: 1270) |
| 227 | +CA + CCA + GAYAARAARCATCARAARGAACCYCCA (SEQ ID NO: 1271) |
| 227 | +CA + CCA + GAYAARAARCATCARAARGAACCYCCAT (SEQ ID NO: 1272) |

TABLE 5 -continued

| | |
|---|---|
| 227 | +CAC + CA + GAYAARAARCATCARAARGAACCYCCA (SEQ ID NO: 1273) |
| 227 | +CAC + CA + GAYAARAARCATCARAARGAACCYCCAT (SEQ ID NO: 1274) |
| 227 | +CA + C + CAGAYAARAARCATCARAARGAACCYCCA (SEQ ID NO: 1275) |
| 227 | +CA + C + CAGAYAARAARCATCARAARGAACCYCCAT (SEQ ID NO: 1276) |
| 227 | +A + CAC + CAGAYAARAARCATCARAARGAACCYCCA (SEQ ID NO: 1277) |
| 227 | +A + CAC + CAGAYAARAARCATCARAARGAACCYCCAT (SEQ ID NO: 1278) |
| 227 | +ACA + C + CAGAYAARAARCATCARAARGAACCYCCA (SEQ ID NO: 1279) |
| 227 | +ACA + C + CAGAYAARAARCATCARAARGAACCYCCAT (SEQ ID NO: 1280) |
| 227 | +A + CA + CCAGAYAARAARCATCARAARGAACCYCCA (SEQ ID NO: 1281) |
| 227 | +A + CA + CCAGAYAARAARCATCARAARGAACCYCCAT (SEQ ID NO: 1282) |
| 227 | RY + TYWCY + ACA + CCAGAYAARAARCATCARAARGAACCYCCA (SEQ ID NO: 1283) |
| 227 | Y + TYWCY + ACA + CCAGAYAARAARCATCARAARGAACCYCCAT (SEQ ID NO: 1284) |
| 227 | RY + TYWCYA + CA + CCAGAYAARAARCATCARAARGAACCYCCA (SEQ ID NO: 1285) |
| 227 | Y + TYWCYA + CA + CCAGAYAARAARCATCARAARGAACCYCCAT (SEQ ID NO: 1286) |
| 227 | +G + AYAARA + ARCATCARAARGAACCYCCA (SEQ ID NO: 1287) |
| 227 | +G + AYAARA + ARCATCARAARGAACCYCCAT (SEQ ID NO: 1288) |
| 227 | +GAYAAR + A + ARCATCARAARGAACCYCCA (SEQ ID NO: 1289) |
| 227 | +GAYAAR + A + ARCATCARAARGAACCYCCAT (SEQ ID NO: 1290) |
| 227 | +G + AYAAR + AARCATCARAARGAACCYCCA (SEQ ID NO: 1291) |
| 227 | +G + AYAAR + AARCATCARAARGAACCYCCAT (SEQ ID NO: 1292) |
| 227 | +CA + GAYAAR + AARCATCARAARGAACCYCCA (SEQ ID NO: 1293) |
| 227 | +CA + GAYAAR + AARCATCARAARGAACCYCCAT (SEQ ID NO: 1294) |
| 227 | +CAG + AYAAR + AARCATCARAARGAACCYCCA (SEQ ID NO: 1295) |
| 227 | +CAG + AYAAR + AARCATCARAARGAACCYCCAT (SEQ ID NO: 1296) |
| 227 | +CA + G + AYAARAARCATCARAARGAACCYCCA (SEQ ID NO: 1297) |
| 227 | +CA + G + AYAARAARCATCARAARGAACCYCCAT (SEQ ID NO: 1298) |
| 227 | +C + CAG + AYAARAARCATCARAARGAACCYCCA (SEQ ID NO: 1299) |
| 227 | +C + CAG + AYAARAARCATCARAARGAACCYCCAT (SEQ ID NO: 1300) |
| 227 | +CCA + G + AYAARAARCATCARAARGAACCYCCA (SEQ ID NO: 1301) |
| 227 | +CCA + G + AYAARAARCATCARAARGAACCYCCAT (SEQ ID NO: 1302) |
| 227 | +C + CA + GAYAARAARCATCARAARGAACCYCCA (SEQ ID NO: 1303) |
| 227 | +C + CA + GAYAARAARCATCARAARGAACCYCCAT (SEQ ID NO: 1304) |
| 227 | RY + TYWCY + A + CACCAGAYAARAARCATCARAARGAACCYCCA (SEQ ID NO: 1305) |
| 227 | Y + TYWCY + A + CACCAGAYAARAARCATCARAARGAACCYCCAT (SEQ ID NO: 1306) |
| 230 | GAYAARAARCATCARAARGAACCYCCATTYCTTTGG (SEQ ID NO: 1307) |
| 230 | CAGAYAARAARCATCARAARGAACCYCCATTYCTTTGG (SEQ ID NO: 1308) |
| 230 | ACCAGAYAARAARCATCARAARGAACCYCCATTYCTTTGG (SEQ ID NO: 1309) |
| 230 | ARCATCARAARGAACCYCCATTYCTTTGG (SEQ ID NO: 1310) |

| | |
|---|---|
| 230 | AARCATCARAARGAACCYCCATTYCTTTGG (SEQ ID NO: 1311) |
| 230 | AYAARAARCATCARAARGAACCYCCATTYCTTTGG (SEQ ID NO: 1312) |
| 230 | WMYACMCCAGAYAARAARCATCARAARGAACCYCCATTCCTTTGG (SEQ ID NO: 1313) |
| 230 | GAYAARAARCATCARAARGAACCYCCATTYCTTTGG + N (SEQ ID NO: 1314) |
| 230 | CAGAYAARAARCATCARAARGAACCYCCATTYCTTTGG + N (SEQ ID NO: 1315) |
| 230 | ACCAGAYAARAARCATCARAARGAACCYCCATTYCTTTGG + N (SEQ ID NO: 1316) |
| 230 | ARCATCARAARGAACCYCCATTYCTTTGG + N (SEQ ID NO: 1317) |
| 230 | AARCATCARAARGAACCYCCATTYCTTTGG + N (SEQ ID NO: 1318) |
| 230 | AYAARAARCATCARAARGAACCYCCATTYCTTTGG + N (SEQ ID NO: 1319) |
| 230 | WMYACMCCAGAYAARAARCATCARAARGAACCYCCATTCCTTTGG + N (SEQ ID NO: 1320) |
| 230 | +G + AYAARA + ARCATCARAARGAACCYCCATTYCTTTGG (SEQ ID NO: 1321) |
| 230 | +GAYAAR + A + ARCATCARAARGAACCYCCATTYCTTTGG (SEQ ID NO: 1322) |
| 230 | +G + AYAAR + AARCATCARAARGAACCYCCATTYCTTTGG (SEQ ID NO: 1323) |
| 230 | +CA + GAYAAR + AARCATCARAARGAACCYCCATTYCTTTGG (SEQ ID NO: 1324) |
| 230 | +CAG + AYAAR + AARCATCARAARGAACCYCCATTYCTTTGG (SEQ ID NO: 1325) |
| 230 | +CA + G + AYAARAARCATCARAARGAACCYCCATTYCTTTGG (SEQ ID NO: 1326) |
| 230 | A + C + CAG + AYAARAARCATCARAARGAACCYCCATTYCTTTGG (SEQ ID NO: 1327) |
| 230 | A + CCA + G + AYAARAARCATCARAARGAACCYCCATTYCTTTGG (SEQ ID NO: 1328) |
| 230 | +ARC + ATC + ARAARGAACCYCCATTYCTTTGG (SEQ ID NO: 1329) |
| 230 | +ARCAT + C + ARAARGAACCYCCATTYCTTTGG (SEQ ID NO: 1330) |
| 230 | +ARC + AT + CARAARGAACCYCCATTYCTTTGG (SEQ ID NO: 1331) |
| 230 | +A + ARCAT + CARAARGAACCYCCATTYCTTTGG (SEQ ID NO: 1332) |
| 230 | +AARC + AT + CARAARGAACCYCCATTYCTTTGG (SEQ ID NO: 1333) |
| 230 | +A + ARC + ATCARAARGAACCYCCATTYCTTTGG (SEQ ID NO: 1334) |
| 230 | +AYAAR + AARC + ATCARAARGAACCYCCATTYCTTTGG (SEQ ID NO: 1335) |
| 230 | +AYAARA + ARC + ATCARAARGAACCYCCATTYCTTTGG (SEQ ID NO: 1336) |
| 230 | +AYAAR + A + ARCATCARAARGAACCYCCATTYCTTTGG (SEQ ID NO: 1337) |
| 230 | A + C + CA + GAYAARAARCATCARAARGAACCYCCATTYCTTTGG (SEQ ID NO: 1338) |
| 238 | CATTYCTTTGGATGGGDTATGARCTCCATCCTGAYA (SEQ ID NO: 1339) |
| 238 | CCATTYCTTTGGATGGGDTATGARCTCCATCCTGAYA (SEQ ID NO: 1340) |
| 238 | CCYCCATTYCTTTGGATGGGDTATGARCTCCATCCTGAYA (SEQ ID NO: 1341) |
| 238 | GGATGGGDTATGARCTCCATCCTGAYA (SEQ ID NO: 1342) |
| 238 | TGGATGGGDTATGARCTCCATCCTGAYA (SEQ ID NO: 1343) |
| 238 | TYCTTTGGATGGGDTATGARCTCCATCCTGAYA (SEQ ID NO: 1344) |
| 238 | AARGAACCYCCATTYCTYTGGATGGGDTATGARCTCCATCCTGAT (SEQ ID NO: 1345) |
| 238 | CATTYCTTTGGATGGGDTATGARCTCCATCCTGAYA + N (SEQ ID NO: 1346) |
| 238 | CCATTYCTTTGGATGGGDTATGARCTCCATCCTGAYA + N (SEQ ID NO: 1347) |
| 238 | CCYCCATTYCTTTGGATGGGDTATGARCTCCATCCTGAYA + N (SEQ ID NO: 1348) |

TABLE 5 -continued

| | | |
|---|---|---|
| 238 | GGATGGGDTATGARCTCCATCCTGAYA + N | (SEQ ID NO: 1349) |
| 238 | TGGATGGGDTATGARCTCCATCCTGAYA + N | (SEQ ID NO: 1350) |
| 238 | TYCTTTGGATGGGDTATGARCTCCATCCTGAYA + N | (SEQ ID NO: 1351) |
| 238 | AARGAACCYCCATTYCTYTGGATGGGDTATGARCTCCATCCTGAT + N | (SEQ ID NO: 1352) |
| 238 | +CAT + TYCTTT + GGATGGGDTATGARCTCCATCCTGAYA | (SEQ ID NO: 1353) |
| 238 | +CATTYCTT + T + GGATGGGDTATGARCTCCATCCTGAYA | (SEQ ID NO: 1354) |
| 238 | +CAT + TYCTT + TGGATGGGDTATGARCTCCATCCTGAYA | (SEQ ID NO: 1355) |
| 238 | +C + CATTYCTT + TGGATGGGDTATGARCTCCATCCTGAYA | (SEQ ID NO: 1356) |
| 238 | +CCAT + TYCTT + TGGATGGGDTATGARCTCCATCCTGAYA | (SEQ ID NO: 1357) |
| 238 | +C + CAT + TYCTTTGGATGGGDTATGARCTCCATCCTGAYA | (SEQ ID NO: 1358) |
| 238 | +CCY + CCAT + TYCTTTGGATGGGDTATGARCTCCATCCTGAYA | (SEQ ID NO: 1359) |
| 238 | +CCYC + CAT + TYCTTTGGATGGGDTATGARCTCCATCCTGAYA | (SEQ ID NO: 1360) |
| 238 | +G + GAT + GGGDTATGARCTCCATCCTGAYA | (SEQ ID NO: 1361) |
| 238 | +GGA + T + GGGDTATGARCTCCATCCTGAYA | (SEQ ID NO: 1362) |
| 238 | +G + GA + TGGGDTATGARCTCCATCCTGAYA | (SEQ ID NO: 1363) |
| 238 | +T + GGA + TGGGDTATGARCTCCATCCTGAYA | (SEQ ID NO: 1364) |
| 238 | +TG + GA + TGGGDTATGARCTCCATCCTGAYA | (SEQ ID NO: 1365) |
| 238 | +T + G + GATGGGDTATGARCTCCATCCTGAYA | (SEQ ID NO: 1366) |
| 238 | +TYCTT + TG + GATGGGDTATGARCTCCATCCTGAYA | (SEQ ID NO: 1367) |
| 238 | +TYCTTT + G + GATGGGDTATGARCTCCATCCTGAYA | (SEQ ID NO: 1368) |
| 238 | +TYCTT + T + GGATGGGTATGARCTCCATCCTGAYA | (SEQ ID NO: 1369) |
| 238 | +CCY + C + CATTYCTTTGGATGGGDTATGARCTCCATCCTGAYA | (SEQ ID NO: 1370) |
| 318 | TTYTAARARMMCCWGTRCATGGRGYVTA | (SEQ ID NO: 1371) |
| 318 | AAYAGRGARATTYTAARARMMCCWGTRCATGGRGYVTA | (SEQ ID NO: 1372) |
| 318 | ARAAYAGRGARATTYTAARARMMCCWGTRCATGGRGYVTA | (SEQ ID NO: 1373) |
| 318 | YTRGCRGARAAYAGRGARATTYTRARARMVCCWGTRCATGGAG | (SEQ ID NO: 1374) |
| 318 | TTYTAARARMMCCWGTRCATGGRGYVTA + N | (SEQ ID NO: 1375) |
| 318 | AAYAGRGARATTYTAARARMMCCWGTRCATGGRGYVTA + N | (SEQ ID NO: 1376) |
| 318 | ARAAYAGRGARATTYTAARARMMCCWGTRCATGGRGYVTA + N | (SEQ ID NO: 1377) |
| 318 | YTRGCRGARAAYAGRGARATTYTRARARMVCCWGTRCATGGAG + N | (SEQ ID NO: 1378) |
| 318 | +TTYTAARARMMCCWGTRCATGGRGYV + TA | (SEQ ID NO: 1379) |
| 318 | +TTYTAARARMMCCWGTRCATGGRGYVTA | (SEQ ID NO: 1380) |
| 318 | +AAYAGRGARA + TTYTAARARMMCCWGTRCATGGRGYVTA | (SEQ ID NO: 1381) |
| 318 | +AAYAGRGARATTYTAARARMMCCWGTRCATGGRGYV + TA | (SEQ ID NO: 1382) |
| 318 | +AAYAGRGARA + TTYTAARARMMCCWGTRCATGGRGYV + TA | (SEQ ID NO: 1383) |
| 318 | +AR + AAYAGRGARATTYTAARARMMCCWGTRCATGGRGYV + TA | (SEQ ID NO: 1384) |

TABLE 5 -continued

| | |
|---|---|
| 318 | +ARAAYAGRGARA + TTYTAARARMMCCWGTRCATGGRGYV + TA (SEQ ID NO: 1385) |
| 318 | +AR + AAYAGRGARA + TTYTAARARMMCCWGTRCATGGRGYVTA (SEQ ID NO: 1386) |

| Codon | Reverse Primer (5' to 3') |
|---|---|
| 40 | RTTRTATGGRTTYTCAGGCCCRATTYTTGWRATTTTYCCTTCYTYTTCCAT (SEQ ID NO: 1387) |
| 40 | RTTRTATGGRTTYTCAGGCCCRATTYTTGWRATTTTYCCTTCYTYTTCCAT + N (SEQ ID NO: 1388) |
| 41 | TCAGGCCCAATTYTTGWRATTTTYCCTTCYTYYTCCA (SEQ ID NO: 1389) |
| 41 | TTCAGGCCCAATTYTTGWRATTTTYCCTTCYTYYTCCA (SEQ ID NO: 1390) |
| 41 | TTTTCAGGCCCAATTYTTGWRATTTTYCCTTCYTYYTCCA (SEQ ID NO: 1391) |
| 41 | AATTYTTGWRATTTTYCCTTCYTYYTCCA (SEQ ID NO: 1392) |
| 41 | CCAATTYTTGWRATTTTYCCTTCYTYYTCCA (SEQ ID NO: 1393) |
| 41 | CCCAATTYTTGWRATTTTYCCTTCYTYYTCCA (SEQ ID NO: 1394) |
| 41 | GTRTTRTATGGRTTYTCAGGCCCRATTYTTGWRATTTTYCCTTCYTTTTC (SEQ ID NO: 1395) |
| 41 | TCAGGCCCAATTYTTGWRATTTTYCCTTCYTYYTCCA + N (SEQ ID NO: 1396) |
| 41 | TTCAGGCCCAATTYTTGWRATTTTYCCTTCYTYYTCCA + N (SEQ ID NO: 1397) |
| 41 | TTTTCAGGCCCAATTYTTGWRATTTTYCCTTCYTYYTCCA + N (SEQ ID NO: 1398) |
| 41 | AATTYTTGWRATTTTYCCTTCYTYYTCCA + N (SEQ ID NO: 1399) |
| 41 | CCAATTYTTGWRATTTTYCCTTCYTYYTCCA + N (SEQ ID NO: 1400) |
| 41 | CCCAATTYTTGWRATTTTYCCTTCYTYYTCCA + N (SEQ ID NO: 1401) |
| 41 | GTRTTRTATGGRTTYTCAGGCCCRATTYTTGWRATTTTYCCTTCYTTTTC + N (SEQ ID NO: 1402) |
| 41 | +TCAGG + CCC + AATTYTTGWRATTTTYCCTTCYTYYTCCA (SEQ ID NO: 1403) |
| 41 | +TCAGGC + CC + AATTYTTGWRATTTTYCCTTCYTYYTCCA (SEQ ID NO: 1404) |
| 41 | +TCAGG + C CCAATTYTTGWRATTTTYCCTTCYTYYTCAA (SEQ ID NO: 1405) |
| 41 | +T + TCAGGC + CCAATTYTTGWRATTTTYCCTTCYTYYTCCA (SEQ ID NO: 1406) |
| 41 | +TTCAGG + C + CCAATTYTTGWRATTTTYCCTTCYTYYTCCA (SEQ ID NO: 1407) |
| 41 | +T + TCAGG + CCCAATTYTTGWRATTTTYCCTTCYTYYTCCA (SEQ ID NO: 1408) |
| 41 | +TT + TTCAGG + CCCAATTYTTGWRATTTTYCCTTCYTYYTCCA (SEQ ID NO: 1409) |
| 41 | +TTT + TCAGG + CCCAATTYTTGWRATTTTYCCTTCYTYYTCCA (SEQ ID NO: 1410) |
| 41 | +A + ATT + YTTGWRATTTTYCCTTCYTYYTCCA (SEQ ID NO: 1411) |
| 41 | +AAT + T + YTTGWRATTTTYCCTTCYTYYTCCA (SEQ ID NO: 1412) |
| 41 | +A + AT + TYTTGWRATTTTYCCTTCYTYYTCCA (SEQ ID NO: 1413) |
| 41 | +CC + AAT + TYTTGWRATTTTYCCTTCYTYYTCCA (SEQ ID NO: 1414) |
| 41 | +CCA + AT + TYTTGWRATTTTYCCTTCYTYYTCCA (SEQ ID NO: 1415) |
| 41 | +CC + A + ATTYTTGWRATTTTYCCTTCYTYYTCCA (SEQ ID NO: 1416) |
| 41 | +C + CCA + ATTYTTGWRATTTTYCCTTCYTYYTCCA (SEQ ID NO: 1417) |
| 41 | +CCC + A + ATTYTTGWRATTTTYCCTTCYTYYTCCA (SEQ ID NO: 1418) |
| 41 | +C + CC + AATTYTTGWRATTTTYCCTTCYTYYTCCA (SEQ ID NO: 1419) |
| 41 | +TT + T + TCAGGCCCAATTYTTGWRATTTTYCCTTCYTYYTCCA (SEQ ID NO: 1420) |
| 44 | TRTATGGRTTTTCAGGCCCAATTYTTGWRATTTTYCC (SEQ ID NO: 1421) |

TABLE 5 -continued

| | | |
|---|---|---|
| 44 | TATGGRTTTTCAGGCCCAATTYTTGWRATTTTYCCT | (SEQ ID NO: 1422) |
| 44 | RTTRTATGGRTTTTCAGGCCCAATTYTTGWRATTTTYCC | (SEQ ID NO: 1423) |
| 44 | TRTATGGRTTTTCAGGCCCAATTYTTGWRATTTTYCCT | (SEQ ID NO: 1424) |
| 44 | TRTTRTATGGRTTTTCAGGCCCAATTYTTGWRATTTTYCC | (SEQ ID NO: 1425) |
| 44 | RTTRTATGGRTTTTCAGGCCCAATTYTTGWRATTTTYCCT | (SEQ ID NO: 1426) |
| 44 | TTTCAGGCCCAATTYTTGWRATTTTYCC | (SEQ ID NO: 1427) |
| 44 | TCAGGCCCAATTYTTGWRATTTTYCCT | (SEQ ID NO: 1428) |
| 44 | TGGRTTTTCAGGCCCAATTYTTGWRATTTTYCC | (SEQ ID NO: 1429) |
| 44 | GRTTTTCAGGCCCAATTYTTGWRATTTTYCCT | (SEQ ID NO: 1430) |
| 44 | RTATGGRTTTTCAGGCCCAATTYTTGWRATTTTYCC | (SEQ ID NO: 1431) |
| 44 | ATGGRTTTTCAGGCCCAATTYTTGWRATTTTYCCT | (SEQ ID NO: 1432) |
| 44 | CAAATAYTGGAGTRTTRTATGGRTTYTCAGGCCCRATTYTTGWRATTTTTCC (SEQ ID NO: 1433) | |
| 44 | TRTATGGRTTTTCAGGCCCAATTYTTGWRATTTTYCC + N | (SEQ ID NO: 1434) |
| 44 | TATGGRTTTTCAGGCCCAATTYTTGWRATTTTYCCT + N | (SEQ ID NO: 1435) |
| 44 | RTTRTATGGRTTTTCAGGCCCAATTYTTGWRATTTTYCC + N (SEQ ID NO: 1436) | |
| 44 | TRTATGGRTTTTCAGGCCCAATTYTTGWRATTTTYCCT + N | (SEQ ID NO: 1437) |
| 44 | TRTTRTATGGRTTTTCAGGCCCAATTYTTGWRATTTTYCC + N | (SEQ ID NO: 1438) |
| 44 | RTTRTATGGRTTTTCAGGCCCAATTYTTGWRATTTTYCCT + N (SEQ ID NO: 1439) | |
| 44 | TTTCAGGCCCAATTYTTGWRATTTTYCC + N | (SEQ ID NO: 1440) |
| 44 | TCAGGCCCAATTYTTGWRATTTTYCCT + N | (SEQ ID NO: 1441) |
| 44 | TGGRTTTTCAGGCCCAATTYTTGWRATTTTYCC + N | (SEQ ID NO: 1442) |
| 44 | GRTTTTCAGGCCCAATTYTTGWRATTTTYCCT + N | (SEQ ID NO: 1443) |
| 44 | RTATGGRTTTTCAGGCCCAATTYTTGWRATTTTYCC + N | (SEQ ID NO: 1444) |
| 44 | ATGGRTTTTCAGGCCCAATTYTTGWRATTTTYCCT + N | (SEQ ID NO: 1445) |
| 44 | CAAATAYTGGAGTRTTRTATGGRTTYTCAGGCCCRATTYTTGWRATTTTTCC + N (SEQ ID NO: 1446) | |
| 44 | +T + RTATGGRT + TTTCAGGCCCAATTYTTGWRATTTTYCC | (SEQ ID NO: 1447) |
| 44 | +T + ATGGRTTT + TCAGGCCCAATTYTTGWRATTTTYCCT | (SEQ ID NO: 1448) |
| 44 | +TRTA + TGGRT + TTTCAGGCCCAATTYTTGWRATTTTYCC | (SEQ ID NO: 1449) |
| 44 | +TARG + GRTTT + TCAGGCCCAATTYTTGWRATTTTYCCT | (SEQ ID NO: 1450) |
| 44 | +T + RTA + TGGRTTTTCAGGCCCAATTYTTGWRATTTTYCC | (SEQ ID NO: 1451) |
| 44 | +T + ATG + GRTTTTCAGGCCCAATTYTTGWRATTTTYCCT | (SEQ ID NO: 1452) |
| 44 | +RT + TRTA + TGGRTTTTCAGGCCCAATTYTTGWRATTTTYCC | (SEQ ID NO: 1453) |
| 44 | +TR + TATG + GRTTTTCAGGCCCAATTYTTGWRATTTTYCCT | (SEQ ID NO: 1454) |
| 44 | +RTT + RTA + TGGRTTTTCAGGCCCAATTYTTGWRATTTTYCC | (SEQ ID NO: 1455) |
| 44 | +TRT + ATG + GRTTTTCAGGCCCAATTYTTGWRATTTTYCCT | (SEQ ID NO: 1456) |
| 44 | +RT + T + RTATGGRTTTTCAGGCCCAATTYTTGWRATTTTYCC | (SEQ ID NO: 1457) |
| 44 | +TR + T + ATGGRTTTTCAGGCCCAATTYTTGWRATTTTYCCT | (SEQ ID NO: 1458) |
| 44 | (SEQ ID NO: 1459) | |

TABLE 5 -continued

| 44 | R + T + TRT + ATGGRTTTTCAGGCCCAATTYTTGWRATTTTYCCT (SEQ ID NO: 1460) |
| 44 | +TRT + T RTATGGRTTTTCAGGCCCAATTYTTGWRATTTTYCC (SEQ ID NO: 1461) |
| 44 | R + TTR + T ATGGRTTTTCAGGCCCAATTYTTGWRATTTTYCCT (SEQ ID NO: 1462) |
| 44 | +TTTC + AGG + CCCAATTYTTGWRATTTTYCC (SEQ ID NO: 1463) |
| 44 | +TCAG + GCC + CAATTYTTGWRATTTTYCCT (SEQ ID NO: 1464) |
| 44 | +TTTCAG + G + CCCAATTYTTGWRATTTTYCC (SEQ ID NO: 1465) |
| 44 | +TCAGGC + C + CAATTYTTGWRATTTTYCCT (SEQ ID NO: 1466) |
| 44 | +TTTC + AG + GCCCAATTYTTGWRATTTTYCC (SEQ ID NO: 1467) |
| 44 | +TCAG + GC + CCAATTYTTGWRATTTTYCCT (SEQ ID NO: 1468) |
| 44 | +TGGRT + TTTCAG + GCCCAATTYTTGWRATTTTYCC (SEQ ID NO: 1469) |
| 44 | +GRTTT + TCAGGC + CCAATTYTTGWRATTTTYCCT (SEQ ID NO: 1470) |
| 44 | +TGGRTTTC + AG + GCCCAATTYTTGWRATTTTYCC (SEQ ID NO: 1471) |
| 44 | +GRTTTCAG + GC + CCAATTYTTGWRATTTTYCCT (SEQ ID NO: 1472) |
| 44 | +TGGRT + TTTC + AGGCCCAATTYTTGWRATTTTYCC (SEQ ID NO: 1473) |
| 44 | +GRTTT + TCAG + GCCCAATTYTTGWRATTTTYCCT (SEQ ID NO: 1474) |
| 44 | +RTA + TGGRTTTTC + AGGCCCAATTYTTGWRATTTTYCC (SEQ ID NO: 1475) |
| 44 | +ATG + GRTTTTCAG + GCCCAATTYTTGWRATTTTYCCT (SEQ ID NO: 1476) |
| 44 | +RTATGGRT + TTTC + AGGCCCAATTYTTGWRATTTTYCC (SEQ ID NO: 1477) |
| 44 | +ATGGRTTT + TCAG + GCCCAATTYTTGWRATTTTYCCT (SEQ ID NO: 1478) |
| 44 | +RTA + TGGRT + TTTCAGGCCCAATTYTTGWRATTTTYCC (SEQ ID NO: 1479) |
| 44 | +ATG + GRTTT + TCAGGCCCAATTYTTGWRATTTTYCCT (SEQ ID NO: 1480) |
| 44 | +T + RT + TRTATGGRTTTTCAGGCCCAATTYTTGWRATTTTYCC (SEQ ID NO: 1481) |
| 44 | R + T + TR + TATGGRTTTTCAGGCCCAATTYTTGWRATTTTYCCT (SEQ ID NO: 1482) |
| 62 | AATTTYCTCCAYTTRGTRCTRTYYTTYTTYTTTATR (SEQ ID NO: 1483) |
| 62 | CTAATTTYCTCCAYTTRGTRCTRTYYTTYTTYTTTATR (SEQ ID NO: 1484) |
| 62 | TACTAATTTYCTCCAYTTRGTRCTRTYYTTYTTYTTTATR (SEQ ID NO: 1485) |
| 62 | TCCAYTTRGTRCTRTYYTTYTTYTTTATR (SEQ ID NO: 1486) |
| 62 | CTCCAYTTRGTRCTRTYYTTYTTYTTTATR (SEQ ID NO: 1487) |
| 62 | TTYCTCCAYTTRGTRCTRTYYTTYTTYTTTATR (SEQ ID NO: 1488) |
| 62 | YTCYCTRAARTCYACTAATTTYCTCCAYTTRGTRCTRTCYTTYTTCTTTAT (SEQ ID NO: 1489) |
| 62 | AATTTYCTCCAYTTRGTRCTRTYYTTYTTYTTTATR + N (SEQ ID NO: 1490) |
| 62 | CTAATTTYCTCCAYTTRGTRCTRTYYTTYTTYTTTATR + N (SEQ ID NO: 1491) |
| 62 | TACTAATTTYCTCCAYTTRGTRCTRTYYTTYTTYTTTATR + N (SEQ ID NO: 1492) |
| 62 | TCCAYTTRGTRCTRTYYTTYTTYTTTATR + N (SEQ ID NO: 1493) |
| 62 | CTCCAYTTRGTRCTRTYYTTYTTYTTTATR + N (SEQ ID NO: 1494) |
| 62 | TTYCTCCAYTTRGTRCTRTYYTTYTTYTTTATR + N (SEQ ID NO: 1495) |
| 62 | YTCYCTRAARTCYACTAATTTYCTCCAYTTRGTRCTRTCYTTYTTCTTTAT + N (SEQ ID NO: 1496) |
| 62 | +AAT + TTYC + TCCAYTTRGTRCTRTYYTTYTTYTTTATR (SEQ ID NO: 1497) |
| 62 | +AATTTY + C + TCCAYTTRGTRCTRTYYTTYTTYTTTATR (SEQ ID NO: 1498) |
| 62 | +AAT + TTY + CTCCAYTTRGTRCTRTYYTTYTTYTTTATR (SEQ ID NO: 1499) |

TABLE 5 -continued

| | | |
|---|---|---|
| 62 | +CT + AATTTY + CTCCAYTTRGTRCTRTYYTTYTTYTTTATR | (SEQ ID NO: 1500) |
| 62 | +CTAAT + TTY + CTCCAYTTRGTRCTRTYYTTYTTYTTTATR | (SEQ ID NO: 1501) |
| 62 | +CT + AAT + TTYCTCCAYTTRGTRCTRTYYTTYTTYTTTATR | (SEQ ID NO: 1502) |
| 62 | T + A + CTAAT + TTYCTCCAYTTRGTRCTRTYYTTYTTYTTTATR | (SEQ ID NO: 1503) |
| 62 | T + ACT + AAT + TTYCTCCAYTTRGTRCTRTYYTTYTTYTTTATR | (SEQ ID NO: 1504) |
| 62 | +TCCAYTTRGTR + CTRT + YYTTYTTYTTTATR | (SEQ ID NO: 1505) |
| 62 | +TCCAYTTRGTRCTR + T + YYTTYTTYTTTATR | (SEQ ID NO: 1506) |
| 62 | +TCCAYTTRGTR + CTR + TYYTTYTTYTTTATR | (SEQ ID NO: 1507) |
| 62 | +C + TCCAYTTRGTRCTR + TYYTTYTTYTTTATR | (SEQ ID NO: 1508) |
| 62 | +CTCCAYTTRGTR + CTR + TYYTTYTTYTTTATR | (SEQ ID NO: 1509) |
| 62 | +C + TCCAYTTRGTR + CTRTYYTTYTTYTTTATR | (SEQ ID NO: 1510) |
| 62 | +TTY + CTCCAYTTRGTR + CTRTYYTTYTTYTTTATR | (SEQ ID NO: 1511) |
| 62 | +TTYC + TCCAYTTRGTR + CTRTYYTTYTTYTTTATR | (SEQ ID NO: 1512) |
| 62 | +TTY + C + TCCAYTTRGTRCTRTYYTTYTTYTTTATR | (SEQ ID NO: 1513) |
| 62 | T + A + CT + AATTTYCTCCAYTTRGTRCTRTYYTTYTTYTTTATR | (SEQ ID NO: 1514) |
| 65 | AATTTYCTCCAYTTRGTRCTRTYYTTY | (SEQ ID NO: 1515) |
| 65 | CTAATTTYCTCCAYTTRGTRCTRTYYTT | (SEQ ID NO: 1516) |
| 65 | TRAARTCTACTAATTTYCTCCAYTTRGTRCTRTYYTTY | (SEQ ID NO: 1517) |
| 65 | YCTRAARTCTACTAATTTYCTCCAYTTRGTRCTRTYYTT | (SEQ ID NO: 1518) |
| 65 | YCTRAARTCTACTAATTTYCTCCAYTTRGTRCTRTYYTTY | (SEQ ID NO: 1519) |
| 65 | CYCTRAARTCTACTAATTTYCTCCAYTTRGTRCTRTYYTT | (SEQ ID NO: 1520) |
| 65 | YCTCCAYTTRGTRCTRTYYTTY | (SEQ ID NO: 1521) |
| 65 | TTYCTCCAYTTRGTRCTRTYYTT | (SEQ ID NO: 1522) |
| 65 | TYCTCCAYTTRGTRCTRTYYTTY | (SEQ ID NO: 1523) |
| 65 | TTTYCTCCAYTTRGTRCTRTYYTT | (SEQ ID NO: 1524) |
| 65 | TTYCTCCAYTTRGTRCTRTYYTTY | (SEQ ID NO: 1525) |
| 65 | ATTTYCTCCAYTTRGTRCTRTYYTT | (SEQ ID NO: 1526) |
| 65 | YTTATTRAGYTCYCTRAARTCYACTAATTTYCTCCAYTTRGTRCTGTCTTT | (SEQ ID NO: 1527) |
| 65 | AATTTYCTCCAYTTRGTRCTRTYYTTY + N | (SEQ ID NO: 1528) |
| 65 | CTAATTTYCTCCAYTTRGTRCTRTYYTT + N | (SEQ ID NO: 1529) |
| 65 | TRAARTCTACTAATTTYCTCCAYTTRGTRCTRTYYTTY + N | (SEQ ID NO: 1530) |
| 65 | YCTRAARTCTACTAATTTYCTCCAYTTRGTRCTRTYYTT + N | (SEQ ID NO: 1531) |
| 65 | YCTRAARTCTACTAATTTYCTCCAYTTRGTRCTRTYYTTY + N | (SEQ ID NO: 1532) |
| 65 | CYCTRAARTCTACTAATTTYCTCCAYTTRGTRCTRTYYTT + N | (SEQ ID NO: 1533) |
| 65 | YCTCCAYTTRGTRCTRTYYTTY + N | (SEQ ID NO: 1534) |
| 65 | TTYCTCCAYTTRGTRCTRTYYTT + N | (SEQ ID NO: 1535) |
| 65 | TYCTCCAYTTRGTRCTRTYYTTY + N | (SEQ ID NO: 1536) |
| 65 | TTTYCTCCAYTTRGTRCTRTYYTT + N | (SEQ ID NO: 1537) |
| 65 | TTYCTCCAYTTRGTRCTRTYYTTY + N | (SEQ ID NO: 1538) |

TABLE 5 -continued

| | |
|---|---|
| 65 | ATTTYCTCCAYTTRGTRCTRTYYTT + N (SEQ ID NO: 1539) |
| 65 | YTTATTRAGYTCYCTRAARTCYACTAATTTYCTCCAYTTRGTRCTGTCTTT + N (SEQ ID NO: 1540) |
| 65 | +AAT + TT + YCTCCAYTTRGTRCTRTYYTTY (SEQ ID NO: 1541) |
| 65 | +CTA + AT + TTYCTCCAYTTRGTRCTRTYYTT (SEQ ID NO: 1542) |
| 65 | +AATT + T + YCTCCAYTTRGTRCTRTYYTTY (SEQ ID NO: 1543) |
| 65 | +CTAA + T + TTYCTCCAYTTRGTRCTRTYYTT (SEQ ID NO: 1544) |
| 65 | +AAT + T + TYCTCCAYTTRGTRCTRTYYTTY (SEQ ID NO: 1545) |
| 65 | +CTA + A + TTTYCTCCAYTTRGTRCTRTYYTT (SEQ ID NO: 1546) |
| 65 | +TRAARTCTACT + AATT + TYCTCCAYTTRGTRCTRTYYTTY (SEQ ID NO: 1547) |
| 65 | +YCTRAARTCTA + CTAA + TTTYCTCCAYTTRGTRCTRTYYTT (SEQ ID NO: 1548) |
| 65 | +TRAARTCTACTAAT + T + TYCTCCAYTTRGTRCTRTYYTTY (SEQ ID NO: 1549) |
| 65 | +YCTRAARTCTACTA + A + TTTYCTCCAYTTRGTRCTRTYYTT (SEQ ID NO: 1550) |
| 65 | +TRAARTCTACT + AAT + TTYCTCCAYTTRGTRCTRTYYTTY (SEQ ID NO: 1551) |
| 65 | +YCTRAARTCTA + CTA + ATTTYCTCCAYTTRGTRCTRTYYTT (SEQ ID NO: 1552) |
| 65 | Y + C + TRAARTCTACTAAT + TTYCTCCAYTTRGTRCTRTYYTTY (SEQ ID NO: 1553) |
| 65 | +C + YCTRAARTCTACTA + ATTTYCTCCAYTTRGTRCTRTYYTT (SEQ ID NO: 1554) |
| 65 | Y + CTRAARTCTACT + AAT + TTYCTCCAYTTRGTRCTRTYYTTY (SEQ ID NO: 1555) |
| 65 | +CYCTRAARTCTA + CTA + ATTTYCTCCAYTTRGTRCTRTYYTT (SEQ ID NO: 1556) |
| 65 | +Y + CTC + CAYTTRGTRCTRTYYTTY (SEQ ID NO: 1557) |
| 65 | +T + TYC + TCCAYTTRGTRCTRTYYTT (SEQ ID NO: 1558) |
| 65 | +YC + TC + CAYTTRGTRCTRTYYTTY (SEQ ID NO: 1559) |
| 65 | +TT + YC + TCCAYTTRGTRCTRTYYTT (SEQ ID NO: 1560) |
| 65 | +Y + C + TCCAYTTRGTRCTRTYYTTY (SEQ ID NO: 1561) |
| 65 | +T + T + YCTCCAYTTRGTRCTRTYYTT (SEQ ID NO: 1562) |
| 65 | +T + YC + TCCAYTTRGTRCTRTYYTTY (SEQ ID NO: 1563) |
| 65 | +T + TT + YCTCCAYTTRGTRCTRTYYTT (SEQ ID NO: 1564) |
| 65 | +TY + C + TCCAYTTRGTRCTRTYYTTY (SEQ ID NO: 1565) |
| 65 | +TT + T + YCTCCAYTTRGTRCTRTYYTT (SEQ ID NO: 1566) |
| 65 | +T + Y + CTCCAYTTRGTRCTRTYYTTY (SEQ ID NO: 1567) |
| 65 | +T + T + TYCTCCAYTTRGTRCTRTYYTT (SEQ ID NO: 1568) |
| 65 | +T + TY + CTCCAYTTRGTRCTRTYYTTY (SEQ ID NO: 1569) |
| 65 | +A + TT + TYCTCCAYTTRGTRCTRTYYTT (SEQ ID NO: 1570) |
| 65 | +TT + Y + CTCCAYTTRGTRCTRTYYTTY (SEQ ID NO: 1571) |
| 65 | +AT + T + TYCTCCAYTTRGTRCTRTYYTT (SEQ ID NO: 1572) |
| 65 | +T + T + YCTCCAYTTRGTRCTRTYYTTY (SEQ ID NO: 1573) |
| 65 | +A + T + TTYCTCCAYTTRGTRCTRTYYTT (SEQ ID NO: 1574) |
| 65 | Y + C + TRAARTCTACT + AATTTYCTCCAYTTRGTRCTRTYYTTY (SEQ ID NO: 1575) |
| 65 | +C + YCTRAARTCTA + CTAATTTYCTCCAYTTRGTRCTRTYYTT (SEQ ID NO: 1576) |
| 67 | TCTACTAATTTYCTCCAYTTRGTRCTRT (SEQ ID NO: 1577) |

TABLE 5 -continued

| | |
|---|---|
| 67 | ARTCTACTAATTTYCTCCAYTTRGTRCTR (SEQ ID NO: 1578) |
| 67 | RAARTCTACTAATTTYCTCCAYTTRGTRCT (SEQ ID NO: 1579) |
| 67 | RTCTACTAATTTYCTCCAYTTRGTRCTRT (SEQ ID NO: 1580) |
| 67 | AARTCTACTAATTTYCTCCAYTTRGTRCTR (SEQ ID NO: 1581) |
| 67 | TRAARTCTACTAATTTYCTCCAYTTRGTRCT (SEQ ID NO: 1582) |
| 67 | AGYTCYCTRAARTCTACTAATTTYCTCCAYTTRGTRCTRT (SEQ ID NO: 1583) |
| 67 | RAGYTCYCTRAARTCTACTAATTTYCTCCAYTTRGTRCTR (SEQ ID NO: 1584) |
| 67 | TRAGYTCYCTRAARTCTACTAATTTYCTCCAYTTRGTRCT (SEQ ID NO: 1585) |
| 67 | ACTAATTTYCTCCAYTTRGTRCTRT (SEQ ID NO: 1586) |
| 67 | CTACTAATTTYCTCCAYTTRGTRCTR (SEQ ID NO: 1587) |
| 67 | RTCTACTAATTTYCTCCAYTTRGTRCT (SEQ ID NO: 1588) |
| 67 | TACTAATTTYCTCCAYTTRGTRCTRT (SEQ ID NO: 1589) |
| 67 | TCTACTAATTTYCTCCAYTTRGTRCTR (SEQ ID NO: 1590) |
| 67 | ARTCTACTAATTTYCTCCAYTTRGTRCT (SEQ ID NO: 1591) |
| 67 | CTACTAATTTYCTCCAYTTRGTRCTRT (SEQ ID NO: 1592) |
| 67 | RTCTACTAATTTYCTCCAYTTRGTRCTR (SEQ ID NO: 1593) |
| 67 | AARTCTACTAATTTYCTCCAYTTRGTRCT (SEQ ID NO: 1594) |
| 67 | GTTYTYTTATTRAGYTCYCTRAARTCYACTAATTTYCTCCAYTTRGTACT (SEQ ID NO: 1595) |
| 67 | TCTACTAATTTYCTCCAYTTRGTRCTRT + N (SEQ ID NO: 1596) |
| 67 | ARTCTACTAATTTYCTCCAYTTRGTRCTR + N (SEQ ID NO: 1597) |
| 67 | RAARTCTACTAATTTYCTCCAYTTRGTRCT + N (SEQ ID NO: 1598) |
| 67 | RTCTACTAATTTYCTCCAYTTRGTRCTRT + N (SEQ ID NO: 1599) |
| 67 | AARTCTACTAATTTYCTCCAYTTRGTRCTR + N (SEQ ID NO: 1600) |
| 67 | TRAARTCTACTAATTTYCTCCAYTTRGTRCT + N (SEQ ID NO: 1601) |
| 67 | AGYTCYCTRAARTCTACTAATTTYCTCCAYTTRGTRCTRT + N (SEQ ID NO: 1602) |
| 67 | RAGYTCYCTRAARTCTACTAATTTYCTCCAYTTRGTRCTR + N (SEQ ID NO: 1603) |
| 67 | TRAGYTCYCTRAARTCTACTAATTTYCTCCAYTTRGTRCT + N (SEQ ID NO: 1604) |
| 67 | ACTAATTTYCTCCAYTTRGTRCTRT + N (SEQ ID NO: 1605) |
| 67 | CTACTAATTTYCTCCAYTTRGTRCTR + N (SEQ ID NO: 1606) |
| 67 | RTCTACTAATTTYCTCCAYTTRGTRCT + N (SEQ ID NO: 1607) |
| 67 | TACTAATTTYCTCCAYTTRGTRCTRT + N (SEQ ID NO: 1608) |
| 67 | TCTACTAATTTYCTCCAYTTRGTRCTR + N (SEQ ID NO: 1609) |
| 67 | ARTCTACTAATTTYCTCCAYTTRGTRCT + N (SEQ ID NO: 1610) |
| 67 | CTACTAATTTYCTCCAYTTRGTRCTRT + N (SEQ ID NO: 1611) |
| 67 | RTCTACTAATTTYCTCCAYTTRGTRCTR + N (SEQ ID NO: 1612) |
| 67 | AARTCTACTAATTTYCTCCAYTTRGTRCT + N (SEQ ID NO: 1613) |
| 67 | GTTYTYTTATTRAGYTCYCTRAARTCYACTAATTTYCTCCAYTTRGTACT + N (SEQ ID NO: 1614) |
| 67 | +T + CT + ACTAATTTYCTCCAYTTRGTRCTRT (SEQ ID NO: 1615) |
| 67 | +A + RT + CTACTAATTTYCTCCAYTTRGTRCTR (SEQ ID NO: 1616) |

TABLE 5 -continued

| 67 | +R + AA + RTCTACTAATTTYCTCCAYTTRGTRCT (SEQ ID NO: 1617) |
| --- | --- |
| 67 | +TC + T + ACTAATTTYCTCCAYTTRGTRCTRT (SEQ ID NO: 1618) |
| 67 | +AR + T + CTACTAATTTYCTCCAYTTRGTRCTR (SEQ ID NO: 1619) |
| 67 | +RA + A + RTCTACTAATTTYCTCCAYTTRGTRCT (SEQ ID NO: 1620) |
| 67 | +T + C + TACTAATTTYCTCCAYTTRGTRCTRT (SEQ ID NO: 1621) |
| 67 | +A + R + TCTACTAATTTYCTCCAYTTRGTRCTR (SEQ ID NO: 1622) |
| 67 | +R + A + ARTCTACTAATTTYCTCCAYTTRGTRCT (SEQ ID NO: 1623) |
| 67 | +R + TC + TACTAATTTYCTCCAYTTRGTRCTRT (SEQ ID NO: 1624) |
| 67 | +A + AR + TCTACTAATTTYCTCCAYTTRGTRCTR (SEQ ID NO: 1625) |
| 67 | +T + RA + ARTCTACTAATTTYCTCCAYTTRGTRCT (SEQ ID NO: 1626) |
| 67 | +RT + C + TACTAATTTYCTCCAYTTRGTRCTRT (SEQ ID NO: 1627) |
| 67 | +AA + R + TCTACTAATTTYCTCCAYTTRGTRCTR (SEQ ID NO: 1628) |
| 67 | +TR + A + ARTCTACTAATTTYCTCCAYTTRGTRCT (SEQ ID NO: 1629) |
| 67 | +R + T + CTACTAATTTYCTCCAYTTRGTRCTRT (SEQ ID NO: 1630) |
| 67 | +A + A + RTCTACTAATTTYCTCCAYTTRGTRCTR (SEQ ID NO: 1631) |
| 67 | +T + R + AARTCTACTAATTTYCTCCAYTTRGTRCT (SEQ ID NO: 1632) |
| 67 | +AGYTCYCT + RAAR + TCTACTAATTTYCTCCAYTTRGTRCTRT (SEQ ID NO: 1633) |
| 67 | RAGYTCY + CTR + AA + RTCTACTAATTTYCTCCAYTTRGTRCTR (SEQ ID NO: 1634) |
| 67 | +TRAGYT + CYCT + RAARTCTACTAATTTYCTCCAYTTRGTRCT (SEQ ID NO: 1635) |
| 67 | RAGYTCY + CTRA + A + RTCTACTAATTTYCTCCAYTTRGTRCTR (SEQ ID NO: 1636) |
| 67 | +AC + TAAT + TTYCTCCAYTTRGTRCTRT (SEQ ID NO: 1637) |
| 67 | +CT + ACTA + ATTTYCTCCAYTTRGTRCTR (SEQ ID NO: 1638) |
| 67 | +RT + CTAC + TAATTTYCTCCAYTTRGTRCT (SEQ ID NO: 1639) |
| 67 | +ACT + AAT + TTYCTCCAYTTRGTRCTRT (SEQ ID NO: 1640) |
| 67 | +CTA + CTA + ATTTYCTCCAYTTRGTRCTR (SEQ ID NO: 1641) |
| 67 | +RTC + TAC + TAATTTYCTCCAYTTRGTRCT (SEQ ID NO: 1642) |
| 67 | +AC + T + AATTTYCTCCAYTTRGTRCTRT (SEQ ID NO: 1643) |
| 67 | +CT + A + CTAATTTYCTCCAYTTRGTRCTR (SEQ ID NO: 1644) |
| 67 | +RT + C + TACTAATTTYCTCCAYTTRGTRCT (SEQ ID NO: 1645) |
| 67 | +T + ACT + AATTTYCTCCAYTTRGTRCTRT (SEQ ID NO: 1646) |
| 67 | +T + CTA + CTAATTTYCTCCAYTTRGTRCTR (SEQ ID NO: 1647) |
| 67 | +A + RTC + TACTAATTTYCTCCAYTTRGTRCT (SEQ ID NO: 1648) |
| 67 | +TAC + T + AATTTYCTCCAYTTRGTRCTRT (SEQ ID NO: 1649) |
| 67 | +TCT + A + CTAATTTYCTCCAYTTRGTRCTR (SEQ ID NO: 1650) |
| 67 | +ART + C + TACTAATTTYCTCCAYTTRGTRCT (SEQ ID NO: 1651) |
| 67 | +TA + AC + TAATTTYCTCCAYTTRGTRCTRT (SEQ ID NO: 1652) |
| 67 | +T + CT + ACTAATTTYCTCCAYTTRGTRCTR (SEQ ID NO: 1653) |
| 67 | +A + RT + CTACTAATTTYCTCCAYTTRGTRCT (SEQ ID NO: 1654) |
| 67 | +C + TAC + TAATTTYCTCCAYTTRGTRCTRT (SEQ ID NO: 1655) |
| 67 | +R + TCT + ACTAATTTYCTCCAYTTRGTRCTR (SEQ ID NO: 1656) |

TABLE 5 -continued

| | | |
|---|---|---|
| 67 | +A + ART + CTACTAATTTYCTCCAYTTRGTRCT (SEQ ID NO: 1657) | |
| 67 | +CT + AC + TAATTTYCTCCAYTTRGTRCTRT (SEQ ID NO: 1658) | |
| 67 | +RT + CT + ACTAATTTYCTCCAYTTRGTRCTR (SEQ ID NO: 1659) | |
| 67 | +AA + RT + CTACTAATTTYCTCCAYTTRGTRCT (SEQ ID NO: 1660) | |
| 67 | +C + T + ACTAATTTYCTCCAYTTRGTRCTRT (SEQ ID NO: 1661) | |
| 67 | +R + T + CTACTAATTTYCTCCAYTTRGTRCTR (SEQ ID NO: 1662) | |
| 67 | +A + A + RTCTACTAATTTYCTCCAYTTRGTRCT (SEQ ID NO: 1663) | |
| 67 | AGYTCYCT + RAA + R + TCTACTAATTTYCTCCAYTTRGTRCTRT (SEQ ID NO: 1664) | |
| 67 | RAGYTCY + CTR + A + ARTCTACTAATTTYCTCCAYTTRGTRCTR (SEQ ID NO: 1665) | |
| 67 | TRAGYT + CYC + T + RAARTCTACTAATTTYCTCCAYTTRGTRCT (SEQ ID NO: 1666) | |
| 69 | RTCYTGAGTTYTYTTATTRAGYTCYCTRAARTCYACTAATTTYCTCCATTT (SEQ ID NO: 1667) | |
| 69 | RTCYTGAGTTYTYTTATTRAGYTCYCTRAARTCYACTAATTTYCTCCATTT + N (SEQ ID NO: 1668) | |
| 70 | TATTRAGYTCYCTRAARTCTACTAATTTYCTCCAYT (SEQ ID NO: 1669) | |
| 70 | YTTATTRAGYTCYCTRAARTCTACTAATTTYCTCCAY (SEQ ID NO: 1670) | |
| 70 | TTATTRAGYTCYCTRAARTCTACTAATTTYCTCCAYT (SEQ ID NO: 1671) | |
| 70 | TYTTATTRAGYTCYCTRAARTCTACTAATTTYCTCCAY (SEQ ID NO: 1672) | |
| 70 | CTYTTATTRAGYTCYCTRAARTCTACTAATTTYCTCCAYT (SEQ ID NO: 1673) | |
| 70 | TCTYTTATTRAGYTCYCTRAARTCTACTAATTTYCTCCAY (SEQ ID NO: 1674) | |
| 70 | RAGYTCYCTRAARTCTACTAATTTYCTCCAYT (SEQ ID NO: 1675) | |
| 70 | TTRAGYTCYCTRAARTCTACTAATTTYCTCCAY (SEQ ID NO: 1676) | |
| 70 | TTRAGYTCYCTRAARTCTACTAATTTYCTCCAYT (SEQ ID NO: 1677) | |
| 70 | TATTRAGYTCYCTRAARTCTACTAATTTYCTCCAY (SEQ ID NO: 1678) | |
| 70 | ATTRAGYTCYCTRAARTCTACTAATTTYCTCCAYT (SEQ ID NO: 1679) | |
| 70 | TTATTRAGYTCYCTRAARTCTACTAATTTYCTCCAY (SEQ ID NO: 1680) | |
| 70 | AARTCYTGAGTTYTYTTATTRAGYTCYCTRAARTCYACTAATTTYCTCCA (SEQ ID NO: 1681) | |
| 70 | TATTRAGYTCYCTRAARTCTACTAATTTYCTCCAYT + N (SEQ ID NO: 1682) | |
| 70 | YTTATTRAGYTCYCTRAARTCTACTAATTTYCTCCAY + N (SEQ ID NO: 1683) | |
| 70 | TTATTRAGYTCYCTRAARTCTACTAATTTYCTCCAYT + N (SEQ ID NO: 1684) | |
| 70 | TYTTATTRAGYTCYCTRAARTCTACTAATTTYCTCCAY + N (SEQ ID NO: 1685) | |
| 70 | CTYTTATTRAGYTCYCTRAARTCTACTAATTTYCTCCAYT + N (SEQ ID NO: 1686) | |
| 70 | TCTYTTATTRAGYTCYCTRAARTCTACTAATTTYCTCCAY + N (SEQ ID NO: 1687) | |
| 70 | RAGYTCYCTRAARTCTACTAATTTYCTCCAYT + N (SEQ ID NO: 1688) | |
| 70 | TTRAGYTCYCTRAARTCTACTAATTTYCTCCAY + N (SEQ ID NO: 1689) | |
| 70 | TTRAGYTCYCTRAARTCTACTAATTTYCTCCAYT + N (SEQ ID NO: 1690) | |
| 70 | TATTRAGYTCYCTRAARTCTACTAATTTYCTCCAY + N (SEQ ID NO: 1691) | |
| 70 | ATTRAGYTCYCTRAARTCTACTAATTTYCTCCAYT + N (SEQ ID NO: 1692) | |
| 70 | TTATTRAGYTCYCTRAARTCTACTAATTTYCTCCAY + N (SEQ ID NO: 1693) | |
| 70 | AARTCYTGAGTTYTYTTATTRAGYTCYCTRAARTCYACTAATTTYCTCCA + N (SEQ ID NO: 1694) | |

TABLE 5 -continued

| | | |
|---|---|---|
| 70 | +T + ATT + RAGYTCYCTRAARTCTACTAATTTYCTCCAYT | (SEQ ID NO: 1695) |
| 70 | +Y + TTA + TTRAGYTCYCTRAARTCTACTAATTTYCTCCAY | (SEQ ID NO: 1696) |
| 70 | +TA + TT + RAGYTCYCTRAARTCTACTAATTTYCTCCAYT | (SEQ ID NO: 1697) |
| 70 | +YT + TA + TTRAGYTCYCTRAARTCTACTAATTTYCTCCAY | (SEQ ID NO: 1698) |
| 70 | +T + A + TTRAGYTCYCTRAARTCTACTAATTTYCTCCAYT | (SEQ ID NO: 1699) |
| 70 | +Y + T + TATTRAGYTCYCTRAARTCTACTAATTTYCTCCAY | (SEQ ID NO: 1700) |
| 70 | +T + TA + TTRAGYTCYCTRAARTCTACTAATTTYCTCCAYT | (SEQ ID NO: 1701) |
| 70 | +T + YT + TATTRAGYTCYCTRAARTCTACTAATTTYCTCCAY | (SEQ ID NO: 1702) |
| 70 | +TT + A + TTRAGYTCYCTRAARTCTACTAATTTYCTCCAYT | (SEQ ID NO: 1703) |
| 70 | +TY + T + TATTRAGYTCYCTRAARTCTACTAATTTYCTCCAY | (SEQ ID NO: 1704) |
| 70 | +T + T + ATTRAGYTCYCTRAARTCTACTAATTTYCTCCAYT | (SEQ ID NO: 1705) |
| 70 | +T + Y + TTATTRAGYTCYCTRAARTCTACTAATTTYCTCCAY | (SEQ ID NO: 1706) |
| 70 | CT + Y + TT + ATTRAGYTCYCTRAARTCTACTAATTTYCTCCAYT | (SEQ ID NO: 1707) |
| 70 | T + C + TY + TTATTRAGYTCYCTRAARTCTACTAATTTYCTCCAY | (SEQ ID NO: 1708) |
| 70 | CT + YT + T + ATTRAGYTCYCTRAARTCTACTAATTTYCTCCAYT | (SEQ ID NO: 1709) |
| 70 | T + CT + Y + TTATTRAGYTCYCTRAARTCTACTAATTTYCTCCAY | (SEQ ID NO: 1710) |
| 70 | +R + AGYTCYCT + RAARTCTACTAATTTYCTCCAYT | (SEQ ID NO: 1711) |
| 70 | +T + TRAGYTCY + CTRAARTCTACTAATTTYCTCCAY | (SEQ ID NO: 1712) |
| 70 | +RAGY + TCYCT + RAARTCTACTAATTTYCTCCAYT | (SEQ ID NO: 1713) |
| 70 | +TTRA + GYTCY + CTRAARTCTACTAATTTYCTCCAY | (SEQ ID NO: 1714) |
| 70 | +R + AGY + TCYCTRAARTCTACTAATTTYCTCCAYT | (SEQ ID NO: 1715) |
| 70 | +T + TRA + GYTCYCTRAARTCTACTAATTTYCTCCAY | (SEQ ID NO: 1716) |
| 70 | +TT + RAGY + TCYCTRAARTCTACTAATTTYCTCCAYT | (SEQ ID NO: 1717) |
| 70 | +TA + TTRA + GYTCYCTRAARTCTACTAATTTYCTCCAY | (SEQ ID NO: 1718) |
| 70 | +TTR + AGY + TCYCTRAARTCTACTAATTTYCTCCAYT | (SEQ ID NO: 1719) |
| 70 | +TAT + TRA + GYTCYCTRAARTCTACTAATTTYCTCCAY | (SEQ ID NO: 1720) |
| 70 | +TT + R + AGYTCYCTRAARTCTACTAATTTYCTCCAYT | (SEQ ID NO: 1721) |
| 70 | +TA + T + TRAGYTCYCTRAARTCTACTAATTTYCTCCAY | (SEQ ID NO: 1722) |
| 70 | +A + TTR + AGYTCYCTRAARTCTACTAATTTYCTCCAYT | (SEQ ID NO: 1723) |
| 70 | +T + TAT + TRAGYTCYCTRAARTCTACTAATTTYCTCCAY | (SEQ ID NO: 1724) |
| 70 | +ATT + R + AGYTCYCTRAARTCTACTAATTTYCTCCAYT | (SEQ ID NO: 1725) |
| 70 | +TTA + T + TRAGYTCYCTRAARTCTACTAATTTYCTCCAY | (SEQ ID NO: 1726) |
| 70 | +A + TT + RAGYTCYCTRAARTCTACTAATTTYCTCCAYT | (SEQ ID NO: 1727) |
| 70 | +T + TA + TTRAGYTCYCTRAARTCTACTAATTTYCTCCAY | (SEQ ID NO: 1728) |
| 70 | CT + Y + T + TATTRAGYTCYCTRAARTCTACTAATTTYCTCCAYT | (SEQ ID NO: 1729) |
| 70 | T + C + T + YTTATTRAGYTCYCTRAARTCTACTAATTTYCTCCAY | (SEQ ID NO: 1730) |
| 74 | TGAGTTCTYTTATTRAGYTCYCTRAARTCTACTA | (SEQ ID NO: 1731) |

TABLE 5 -continued

| | | |
|---|---|---|
| 74 | YTGAGTTCTYTTATTRAGYTCYCTRAARTCTACTA | (SEQ ID NO: 1732) |
| 74 | AARTCYTGAGTTCYTTATTRAGYTCYCTRAARTCTACTA | (SEQ ID NO: 1733) |
| 74 | YTTATTRAGYTCYCTRAARTCTACTA | (SEQ ID NO: 1734) |
| 74 | CTYTTATTRAGYTCYCTRAARTCTACTA | (SEQ ID NO: 1735) |
| 74 | GTTCTYTTATTRAGYTCYCTRAARTCTACTA | (SEQ ID NO: 1736) |
| 74 | YTGRACYTCCCARAARTCYTGAGTTYTYTTATTRAGYTCYCTRAAATCTAC | (SEQ ID NO: 1737) |
| 74 | TGAGTTCTYTTATTRAGYTCYCTRAARTCTACTA + N | (SEQ ID NO: 1738) |
| 74 | YTGAGTTCTYTTATTRAGYTCYCTRAARTCTACTA + N | (SEQ ID NO: 1739) |
| 74 | AARTCYTGAGTTCTYTTATTRAGYTCYCTRAARTCTACTA + N | (SEQ ID NO: 1740) |
| 74 | YTTATTRAGYTCYCTRAARTCTACTA + N | (SEQ ID NO: 1741) |
| 74 | CTYTTATTRAGYTCYCTRAARTCTACTA + N | (SEQ ID NO: 1742) |
| 74 | GTTCTYTTATTRAGYTCYCTRAARTCTACTA + N | (SEQ ID NO: 1743) |
| 74 | YTGRACYTCCCARAARTCYTGAGTTYTYTTATTRAGYTCYCTRAAATCTAC + N | (SEQ ID NO: 1744) |
| 74 | +TGA + GTTCT + YTTATTRAGYTCYCTRAARTCTACTA | (SEQ ID NO: 1745) |
| 74 | +TGAGTT + CT + YTTATTRAGYTCYCTRAARTCTACTA | (SEQ ID NO: 1746) |
| 74 | +TGA + GTT + CTYTTATTRAGYTCYCTRAARTCTACTA | (SEQ ID NO: 1747) |
| 74 | +Y + TGAGTT + CTYTTATTRAGYTCYCTRAARTCTACTA | (SEQ ID NO: 1748) |
| 74 | +YTGA + GTT + CTYTTATTRAGYTCYCTRAARTCTACTA | (SEQ ID NO: 1749) |
| 74 | +Y + TGA + GTTCTYTTATTRAGYTCYCTRAARTCTACTA | (SEQ ID NO: 1750) |
| 74 | +AARTC + YTGA + GTTCTYTTATTRAGYTCYCTRAARTCTACTA | (SEQ ID NO: 1751) |
| 74 | +AARTCY + TGA + GTTCTYTTATTRAGYTCYCTRAARTCTACTA | (SEQ ID NO: 1752) |
| 74 | +Y + TTA + TTRAGYTCYCTRAARTCTACTA | (SEQ ID NO: 1753) |
| 74 | +YTT + A + TTRAGYTCYCTRAARTCTACTA | (SEQ ID NO: 1754) |
| 74 | +Y + TT + ATTRAGYTCYCTRAARTCTACTA | (SEQ ID NO: 1755) |
| 74 | +CT + YTT + ATTRAGYTCYCTRAARTCTACTA | (SEQ ID NO: 1756) |
| 74 | +CTY + TT + ATTRAGYTCYCTRAARTCTACTA | (SEQ ID NO: 1757) |
| 74 | +CT + Y + TTATTRAGYTCYCTRAARTCTACTA | (SEQ ID NO: 1758) |
| 74 | +GTT + CTY + TTATTRAGYTCYCTRAARTCTACTA | (SEQ ID NO: 1759) |
| 74 | +GTTCT + Y + TTATTRAGYTCYCTRAARTCTACTA | (SEQ ID NO: 1760) |
| 74 | +GTT + CT + YTTATTRAGYTCYCTRAARTCTACTA | (SEQ ID NO: 1761) |
| 74 | +AARTC + Y + TGAGTTCTYTTATTRAGYTCYCTRAARTCTACTA | (SEQ ID NO: 1762) |
| 75 | TCYTGAGTTCTYTTATTRAGYTCYCTRAARTCTA | (SEQ ID NO: 1763) |
| 75 | ARTCYTGAGTTCTYTTATTRAGYTCYCTRAARTCT | (SEQ ID NO: 1764) |
| 75 | AARTCYTGAGTTCTYTTATTRAGYTCYCTRAARTCTA | (SEQ ID NO: 1765) |
| 75 | ARAARTCYTGAGTTCTYTTATTRAGYTCYCTRAARTCT | (SEQ ID NO: 1766) |
| 75 | CARAARTCYTGAGTTCTYTTATTRAGYTCYCTRAARTCTA | (SEQ ID NO: 1767) |
| 75 | CCARAARTCYTGAGTTCTYTTATTRAGYTCYCTRAARTCT | (SEQ ID NO: 1768) |
| 75 | GTTCTYTTATTRAGYTCYCTRAARTCTA | (SEQ ID NO: 1769) |

TABLE 5 -continued

| 75 | GAGTTCTYTTATTRAGYTCYCTRAARTCT (SEQ ID NO: 1770) |
| --- | --- |
| 75 | AGTTCTYTTATTRAGYTCYCTRAARTCTA (SEQ ID NO: 1771) |
| 75 | TGAGTTCTYTTATTRAGYTCYCTRAARTCT (SEQ ID NO:1772) |
| 75 | TGAGTTCTYTTATTRAGYTCYCTRAARTCTA (SEQ ID NO: 1773) |
| 75 | CYTGAGTTCTYTTATTRAGYTCYCTRAARTCT (SEQ ID NO: 1774) |
| 75 | TAAYTGRACYTCCCARAARTCYTGAGTTYTYTTATTRAGYTCYCTGAAATC (SEQ ID NO: 1775) |
| 75 | TCYTGAGTTCTYTTATTRAGYTCYCTRAARTCTA + N (SEQ ID NO: 1776) |
| 75 | ARTCYTGAGTTCTYTTATTRAGYTCYCTRAARTCT + N (SEQ ID NO: 1777) |
| 75 | AARTCYTGAGTTCTYTTATTRAGYTCYCTRAARTCTA + N (SEQ ID NO: 1778) |
| 75 | ARAARTCYTGAGTTCTYTTATTRAGYTCYCTRAARTCT + N (SEQ ID NO: 1779) |
| 75 | CARAARTCYTGAGTTCTYTTATTRAGYTCYCTRAARTCTA + N (SEQ ID NO: 1780) |
| 75 | CCARAARTCYTGAGTTCTYTTATTRAGYTCYCTRAARTCT + N (SEQ ID NO: 1781) |
| 75 | GTTCTYTTATTRAGYTCYCTRAARTCTA + N (SEQ ID NO: 1782) |
| 75 | GAGTTCTYTTATTRAGYTCYCTRAARTCT + N (SEQ ID NO: 1783) |
| 75 | AGTTCTYTTATTRAGYTCYCTRAARTCTA + N (SEQ ID NO: 1784) |
| 75 | TGAGTTCTYTTATTRAGYTCYCTRAARTCT + N (SEQ ID NO: 1785) |
| 75 | TGAGTTCTYTTATTRAGYTCYCTRAARTCTA + N (SEQ ID NO: 1786) |
| 75 | CYTGAGTTCTYTTATTRAGYTCYCTRAARTCT + N (SEQ ID NO: 1787) |
| 75 | TAAYTGRACYTCCCARAARTCYTGAGTTYTYTTATTRAGYTCYCTGAAATC + N (SEQ ID NO: 1788) |
| 75 | +TCY + TGA + GTTCTYTTATTRAGYTCYCTRAARTCTA (SEQ ID NO: 1789) |
| 75 | +ART + CYT + GAGTTCTYTTATTRAGYTCYCTRAARTCT (SEQ ID NO: 1790) |
| 75 | +TCYTG + A + GTTCTYTTATTRAGYTCYCTRAARTCTA (SEQ ID NO: 1791) |
| 75 | +ARTCY + T + GAGTTCTYTTATTRAGYTCYCTRAARTCT (SEQ ID NO: 1792) |
| 75 | +TCY + TG + AGTTCTYTTATTRAGYTCYCTRAARTCTA (SEQ ID NO: 1793) |
| 75 | +ART + CY + TGAGTTCTYTTATTRAGYTCYCTRAARTCT (SEQ ID NO: 1794) |
| 75 | +AAR + TCYTG + AGTTCTYTTATTRAGYTCYCTRAARTCTA (SEQ ID NO: 1795) |
| 75 | +ARA + ARTCY + TGAGTTCTYTTATTRAGYTCYCTRAARTCT (SEQ ID NO: 1796) |
| 75 | +AARTCY + TG + AGTTCTYTTATTRAGYTCYCTRAARTCTA (SEQ ID NO: 1797) |
| 75 | +ARAART + CY + TGAGTTCTYTTATTRAGYTCYCTRAARTCT (SEQ ID NO: 1798) |
| 75 | +AAR + TCY + TGAGTTCTYTTATTRAGYTCYCTRAARTCTA (SEQ ID NO: 1799) |
| 75 | +ARA + ART + CYTGAGTTCTYTTATTRAGYTCYCTRAARTCT (SEQ ID NO: 1800) |
| 75 | CA + R + AARTCY + TGAGTTCTYTTATTRAGYTCYCTRAARTCTA (SEQ ID NO: 1801) |
| 75 | C + C + ARAART + CYTGAGTTCTYTTATTRAGYTCYCTRAARTCT (SEQ ID NO: 1802) |
| 75 | CA + RAAR + TCY + TGAGTTCTYTTATTRAGYTCYCTRAARTCTA (SEQ ID NO: 1803) |
| 75 | C + CARA + ART + CYTGAGTTCTYTTATTRAGYTCYCTRAARTCT (SEQ ID NO: 1804) |
| 75 | +GT + TCT + YTTATTRAGYTCYCTRAARTCTA (SEQ ID NO: 1805) |
| 75 | +GA + GTT + CTYTTATTRAGYTCYCTRAARTCT (SEQ ID NO: 1806) |
| 75 | +GTT + CT + YTTATTRAGYTCYCTRAARTCTA (SEQ ID NO: 1807) |
| 75 | +GAG + TT + CTYTTATTRAGYTCYCTRAARTCT (SEQ ID NO: 1808) |

TABLE 5 -continued

| | | |
|---|---|---|
| 75 | +GT + T + CTYTTATTRAGYTCYCTRAARTCTA | (SEQ ID NO: 1809) |
| 75 | +GA + G + TTCTYTTATTRAGYTCYCTRAARTCT | (SEQ ID NO: 1810) |
| 75 | +A + GTT + CTYTTATTRAGYTCYCTRAARTCTA | (SEQ ID NO: 1811) |
| 75 | +T + GAG + TTCTYTTATTRAGYTCYCTRAARTCT | (SEQ ID NO: 1812) |
| 75 | +AGT + T + CTYTTATTRAGYTCYCTRAARTCTA | (SEQ ID NO: 1813) |
| 75 | +TGA + G + TTCTYTTATTRAGYTCYCTRAARTCT | (SEQ ID NO: 1814) |
| 75 | +A + GT + TCTYTTATTRAGYTCYCTRAARTCTA | (SEQ ID NO: 1815) |
| 75 | +T + GA + GTCTYTTATTRAGYTCYCTRAARTCT | (SEQ ID NO: 1816) |
| 75 | +TG + AGT + TCTYTTATTRAGYTCYCTRAARTCTA | (SEQ ID NO: 1817) |
| 75 | +CY + TGA + GTTCTYTTATTRAGYTCYCTRAARTCT | (SEQ ID NO: 1818) |
| 75 | +TGA + GT + TCTYTTATTRAGYTCYCTRAARTCTA | (SEQ ID NO: 1819) |
| 75 | +CYT + GA + GTTCTYTTATTRAGYTCYCTRAARTCT | (SEQ ID NO: 1820) |
| 75 | +TG + A + GTTCTYTTATTRAGYTCYCTRAARTCTA | (SEQ ID NO: 1821) |
| 75 | +CY + T + GAGTTCTYTTATTRAGYTCYCTRAARTCT | (SEQ ID NO: 1822) |
| 75 | CA + R + AAR + TCYTGAGTTCTYTTATTRAGYTCYCTRAARTCTA | (SEQ ID NO: 1823) |
| 75 | C + C + ARA + ARTCYTGAGTTCTYTTATTRAGYTCYCTRAARTCT | (SEQ ID NO: 1824) |
| 77 | YTCCCARAARTCYTGAGTTCTYTTATTRAGYTCYCT | (SEQ ID NO: 1825) |
| 77 | CYTCCCARAARTCYTGAGTTCTYTTATTRAGYTCYCT | (SEQ ID NO: 1826) |
| 77 | GRACYTCCCARAARTCYTGAGTTCTYTTATTRAGYTCYCT | (SEQ ID NO: 1827) |
| 77 | ARAARTCYTGAGTTCTYTTATTRAGYTCYCT | (SEQ ID NO: 1828) |
| 77 | CCARAARTCYTGAGTTCTYTTATTRAGYTCYCT | (SEQ ID NO: 1829) |
| 77 | CCCARAARTCYTGAGTTCTYTTATTRAGYTCYCT | (SEQ ID NO: 1830) |
| 77 | TATYCCTAAYTGRACYTCCCARAARTCYTGAGTTYTYTTATTRAGTTCTCT | (SEQ ID NO: 1831) |
| 77 | YTCCCARAARTCYTGAGTTCTYTTATTRAGYTCYCT + N | (SEQ ID NO: 1832) |
| 77 | CYTCCCARAARTCYTGAGTTCTYTTATTRAGYTCYCT + N | (SEQ ID NO: 1833) |
| 77 | GRACYTCCCARAARTCYTGAGTTCTYTTATTRAGYTCYCT + N | (SEQ ID NO: 1834) |
| 77 | ARAARTCYTGAGTTCTYTTATTRAGYTCYCT + N | (SEQ ID NO: 1835) |
| 77 | CCARAARTCYTGAGTTCTYTTATTRAGYTCYCT + N | (SEQ ID NO: 1836) |
| 77 | CCCARAARTCYTGAGTTCTYTTATTRAGYTCYCT + N | (SEQ ID NO: 1837) |
| 77 | TATYCCTAAYTGRACYTCCCARAARTCYTGAGTTYTYTTATTRAGTTCTCT + N (SEQ ID NO: 1838) | |
| 77 | +YT + CCC + ARAARTCYTGAGTTCTYTTATTRAGYTCYCT | (SEQ ID NO: 1839) |
| 77 | +YTC + CC + ARAARTCYTGAGTTCTYTTATTRAGYTCYCT | (SEQ ID NO: 1840) |
| 77 | +YT + C + CCARAARTCYTGAGTTCTYTTATTRAGYTCYCT | (SEQ ID NO: 1841) |
| 77 | +C + YTC + CCARAARTCYTGAGTTCTYTTATTRAGYTCYCT | (SEQ ID NO: 1842) |
| 77 | +CYT + C + CCARAARTCYTGAGTTCTYTTATTRAGYTCYCT | (SEQ ID NO: 1843) |
| 77 | +C + YT + CCCARAARTCYTGAGTTCTYTTATTRAGYTCYCT | (SEQ ID NO: 1844) |
| 77 | +G + RAC + YTCCCARAARTCYTGAGTTCTYTTATTRAGYTCYCT (SEQ ID NO: 1845) | |
| 77 | +A + RAART + CYTGAGTTCTYTTATTRAGYTCYCT | (SEQ ID NO: 1846) |
| 77 | +ARA + ART + CYTGAGTTCTYTTATTRAGYTCYCT | (SEQ ID NO: 1847) |

TABLE 5 -continued

| | |
|---|---|
| 77 | +A + RA + ARTCYTGAGTTCTYTTATTRAGYTCYCT (SEQ ID NO: 1848) |
| 77 | +CC + ARA + ARTCYTGAGTTCTYTTATTRAGYTCYCT (SEQ ID NO: 1849) |
| 77 | +CCA + RA + ARTCYTGAGTTCTYTTATTRAGYTCYCT (SEQ ID NO: 1850) |
| 77 | +CC + A + RAARTCYTGAGTTCTYTTATTRAGYTCYCT (SEQ ID NO: 1851) |
| 77 | +C + CCA + RAARTCYTGAGTTCTYTTATTRAGYTCYCT (SEQ ID NO: 1852) |
| 77 | +CCC + A + RAARTCYTGAGTTCTYTTATTRAGYTCYCT (SEQ ID NO: 1853) |
| 77 | +C + CC + ARAARTCYTGAGTTCTYTTATTRAGYTCYCT (SEQ ID NO: 1854) |
| 77 | G + RA + C + YTCCCARAARTCYTGAGTTCTYTTATTRAGYTCYCT (SEQ ID NO: 1855) |
| 90 | TTTTTTARHCCYGCDGGRTGNGGTATYCCTAATTGRA (SEQ ID NO: 1856) |
| 90 | CTTTTTTARHCCYGCDGGRTGNGGTATYCCTAATTGRA (SEQ ID NO: 1857) |
| 90 | TTCTTTTTTARHCCYGCDGGRTGNGGTATYCCTAATTGRA (SEQ ID NO: 1858) |
| 90 | ARHCCYGCDGGRTGNGGTATYCCTAATTGRA (SEQ ID NO: 1859) |
| 90 | TARHCCYGCDGGRTGNGGTATYCCTAATTGRA (SEQ ID NO: 1860) |
| 90 | TTTARHCCYGCDGGRTGNGGTATYCCTAATTGRA (SEQ ID NO: 1861) |
| 90 | GTYACWGAYTTYTTCTTYTTTARHCCYGCDGGRTGHGGTATYCCTAATTG (SEQ ID NO: 1862) |
| 90 | TTTTTTARHCCYGCDGGRTGNGGTATYCCTAATTGRA + N (SEQ ID NO: 1863) |
| 90 | CTTTTTTARHCCYGCDGGRTGNGGTATYCCTAATTGRA + N (SEQ ID NO: 1864) |
| 90 | TTCTTTTTTARHCCYGCDGGRTGNGGTATYCCTAATTGRA + N (SEQ ID NO: 1865) |
| 90 | ARHCCYGCDGGRTGNGGTATYCCTAATTGRA + N (SEQ ID NO: 1866) |
| 90 | TARHCCYGCDGGRTGNGGTATYCCTAATTGRA + N (SEQ ID NO: 1867) |
| 90 | TTTARHCCYGCDGGRTGNGGTATYCCTAATTGRA + N (SEQ ID NO: 1868) |
| 90 | GTYACWGAYTTYTTCTTYTTTARHCCYGCDGGRTGHGGTATYCCTAATTG + N (SEQ ID NO: 1869) |
| 90 | GGRTGNGGTATYCCTAATTGRA (SEQ ID NO: 1870) |
| 90 | +TTTTT + T + ARHCCYGCDGGRTGNGGTATYCCTAATTGRA (SEQ ID NO: 1871) |
| 90 | +TTT + TT +TARHCCYGCDGGRTGNGGTATYCCTAATTGRA (SEQ ID NO: 1872) |
| 90 | +C + TTTTT + TARHCCYGCDGGRTGNGGTATYCCTAATTGRA (SEQ ID NO: 1873) |
| 90 | +CTTT + TT + TARHCCYGCDGGRTGNGGTATYCCTAATTGRA (SEQ ID NO: 1874) |
| 90 | +C + TTT + TTTARHCCYGCDGGRTGNGGTATYCCTAATTGRA (SEQ ID NO: 1875) |
| 90 | TT + C + TTTTT + TARHCCYGCDGGRTGNGGTATYCCTAATTGRA (SEQ ID NO: 1876) |
| 90 | TTC + TTT + TT + TARHCCYGCDGGRTGNGGTATYCCTAATTGRA (SEQ ID NO: 1877) |
| 90 | +AR + HCC + YGCDGGRTGNGGTATYCCTAATTGRA (SEQ ID NO: 1878) |
| 90 | +ARH + CC + YGCDGGRTGNGGTATYCCTAATTGRA (SEQ ID NO: 1879) |
| 90 | +AR + H + CCYGCDGGRTGNGGTATYCCTAATTGRA (SEQ ID NO: 1880) |
| 90 | +T + ARH + CCYGCDGGRTGNGGTATYCCTAATTGRA (SEQ ID NO: 1881) |
| 90 | +TAR + H + CCYGCDGGRTGNGGTATYCCTAATTGRA (SEQ ID NO: 1882) |

TABLE 5 -continued

| | |
|---|---|
| 90 | +T + AR + HCCYGCDGGRTGNGGTATYCCTAATTGRA (SEQ ID NO: 1883) |
| 90 | +TT + TAR + HCCYGCDGGRTGNGGTATYCCTAATTGRA (SEQ ID NO: 1884) |
| 90 | +TTT + AR + HCCYGCDGGRTGNGGTATYCCTAATTGRA (SEQ ID NO: 1885) |
| 90 | +TT + T + ARHCCYGCDGGRTGNGGTATYCCTAATTGRA (SEQ ID NO: 1886) |
| 90 | +TT + C + TTTTTTARHCCYGCDGGRTGNGGTATYCCTAATTGRA (SEQ ID NO: 1887) |
| 98 | CYARYACTGTYACTGAYTTKTTCTTTTTTARHCCY (SEQ ID NO: 1888) |
| 98 | CATCYARYACTGTYACTGAYTTKTTCTTTTTTARHCCY (SEQ ID NO: 1889) |
| 98 | YACATCYARYACTGTYACTGAYTTKTTCTTTTTTARHCCY (SEQ ID NO: 1890) |
| 98 | AYTTKTTCTTTTTTARHCCY (SEQ ID NO: 1891) |
| 98 | ACTGAYTTKTTCTTTTTTARHCCY (SEQ ID NO: 1892) |
| 98 | GTYACTGAYTTKTTCTTTTTTARHCCY (SEQ ID NO: 1893) |
| 98 | RTATGCATCHCCYACATCYARBACTGTYACWGAYTTYTTCTTYTTTAACCC (SEQ ID NO: 1894) |
| 98 | CYARYACTGTYACTGAYTTKTTCTTTTTTARHC CY + N (SEQ ID NO: 1895) |
| 98 | CATCYARYACTGTYACTGAYTTKTTCTTTTTTARHC CY + N (SEQ ID NO: 1896) |
| 98 | YACATCYARYACTGTYACTGAYTTKTTCTTTTTTARHCCY + N (SEQ ID NO: 1897) |
| 98 | AYTTKTTCTTTTTTARHC CY + N (SEQ ID NO: 1898) |
| 98 | ACTGAYTTKTTCTTTTTTARHC CY + N (SEQ ID NO: 1899) |
| 98 | GTYACTGAYTTKTTCTTTTTTARHCCY + N (SEQ ID NO: 1900) |
| 98 | RTATGCATCHCCYACATCYARBACTGTYACWGAYTTYTTCTTYTTTAACCC + N (SEQ ID NO: 1901) |
| 98 | +CYARYACT + GTYACTG + AYTTKTTCTTTTTTARHCCY (SEQ ID NO: 1902) |
| 98 | +CYARYACTGTY + ACTG + AYTTKTTCTTTTTTARHCCY (SEQ ID NO: 1903) |
| 98 | +CYARYACT + GTY + ACTGAYTTKTTCTTTTTTARHCCY (SEQ ID NO: 1904) |
| 98 | +CAT + CYARYACTGTY + ACTGAYTTKTTCTTTTTTARHCCY (SEQ ID NO: 1905) |
| 98 | +CATCYARYACT + GTY + ACTGAYTTKTTCTTTTTTARHCCY (SEQ ID NO: 1906) |
| 98 | +CAT + CYARYACT + GTYACTGAYTTKTTCTTTTTTARHCCY (SEQ ID NO: 1907) |
| 98 | Y + A + CATCYARYACT + GTYACTGAYTTKTTCTTTTTTARHCCY (SEQ ID NO: 1908) |
| 98 | Y + ACAT + CYARYACT + GTYACTGAYTTKTTCTTTTTTARHCCY (SEQ ID NO: 1909) |
| 98 | +AYTTKT + TCTTTT + TTARHCCY (SEQ ID NO: 1910) |
| 98 | +AYTTKTTCT + TTT + TTARHCCY (SEQ ID NO: 1911) |
| 98 | +AYTTKT + TCT + TTTTARHCCY (SEQ ID NO: 1912) |
| 98 | +ACTG + AYTTKTTCT + TTTTARHCCY (SEQ ID NO: 1913) |
| 98 | +ACTGAYTTKT + TCT + TTTTARHCCY (SEQ ID NO: 1914) |
| 98 | +ACTG + AYTTKT + TCTTTTTARHCCY (SEQ ID NO: 1915) |
| 98 | +GTY + ACTGAYTTKT + TCTTTTTARHCCY (SEQ ID NO: 1916) |
| 98 | +GTYACTG + AYTTKT + TCTTTTTARHCCY (SEQ ID NO: 1917) |
| 98 | +GTY + ACTG + AYTTKTTCTTTTTTARHCCY (SEQ ID NO: 1918) |
| 98 | Y + A + CAT + CYARYACTGTYACTGAYTTKTTCTTTTTTARHCCY (SEQ ID NO: 1919) |

TABLE 5 -continued

| | |
|---|---|
| 100 | YARYACTGTYACTGAYTTKTTCTTTTTTA (SEQ ID NO: 1920) |
| 100 | ATCYARYACTGTYACTGAYTTKTTCTTTTTTA (SEQ ID NO: 1921) |
| 100 | TCHCCYACATCYARYACTGTYACTGAYTTKTTCTTTTTTA (SEQ ID NO: 1922) |
| 100 | GAYTTKTTCTTTTTTA (SEQ ID NO: 1923) |
| 100 | ACTGAYTTKTTCTTTTTTA (SEQ ID NO: 1924) |
| 100 | ACTGTYACTGAYTTKTTCTTTTTTA (SEQ ID NO: 1925) |
| 100 | GARAARTATGCATCHCCYACATCYARBACTGTYACWGAYTTYTTCTTTTT (SEQ ID NO: 1926) |
| 100 | YARYACTGTYACTGAYTTKTTCTTTTTTA + N (SEQ ID NO: 1927) |
| 100 | ATCYARYACTGTYACTGAYTTKTTCTTTTTTA + N (SEQ ID NO: 1928) |
| 100 | TCHCCYACATCYARYACTGTYACTGAYTTKTTCTTTTTTA + N (SEQ ID NO: 1929) |
| 100 | GAYTTKTTCTTTTTTA + N (SEQ ID NO: 1930) |
| 100 | ACTGAYTTKTTCTTTTTTA + N (SEQ ID NO: 1931) |
| 100 | ACTGTYACTGAYTTKTTCTTTTTTA + N (SEQ ID NO: 1932) |
| 100 | GARAARTATGCATCHCCYACATCYARBACTGTYACWGAYTTYTTCTTTTT + N (SEQ ID NO: 1933) |
| 100 | +YARY + ACTGTYACT + GAYTTKTTCTTTTTTA (SEQ ID NO: 1934) |
| 100 | +YARYACTGTY + ACT + GAYTTKTTCTTTTTTA (SEQ ID NO: 1935) |
| 100 | +YARY + ACTGTY + ACTGAYTTKTTCTTTTTTA (SEQ ID NO: 1936) |
| 100 | +ATC + YARYACTGTY + ACTGAYTTKTTCTTTTTTA (SEQ ID NO: 1937) |
| 100 | +ATCYARY + ACTGTY + ACTGAYTTKTTCTTTTTTA (SEQ ID NO: 1938) |
| 100 | +ATC + YARY + ACTGTYACTGAYTTKTTCTTTTTTA (SEQ ID NO: 1939) |
| 100 | +TCHCCYAC + ATCYART + ACTGTYACTGAYTTKTTCTTTTTTA (SEQ ID NO: 1940) |
| 100 | +TCHCCYACATC + YARY + ACTGTYACTGAYTTKTTCTTTTTTA (SEQ ID NO: 1941) |
| 100 | +GAY + TTK + TTCTTTTTTA (SEQ ID NO: 1942) |
| 100 | +GAYTT + K + TTCTTTTTTA (SEQ ID NO: 1943) |
| 100 | +GAY + TT + KTTCTTTTTTA (SEQ ID NO: 1944) |
| 100 | +ACT + GAYTT + KTTCTTTTTTA (SEQ ID NO: 1945) |
| 100 | +ACTGAY + TT + KTTCTTTTTTA (SEQ ID NO: 1946) |
| 100 | +ACT + GAY + TTKTTCTTTTTTA (SEQ ID NO: 1947) |
| 100 | +ACTGTY + ACTGAY + TTKTTCTTTTTTA (SEQ ID NO: 1948) |
| 100 | +ACTGTYACT + GAY + TTKTTCTTTTTTA (SEQ ID NO: 1949) |
| 100 | +ACTGTY + ACT + GAYTTKTTCTTTTTTA (SEQ ID NO: 1950) |
| 100 | +TCHCCYAC + ATC + YARYACTGTYACTGAYTTKTTCTTTTTTA (SEQ ID NO: 1951) |
| 101 | TCYARYACTGTYACTGAYTTKTTCTTTT (SEQ ID NO: 1952) |
| 101 | YACATCYARYACTGTYACTGAYTTKTTCTTTT (SEQ ID NO: 1953) |
| 101 | GCRTCHCCYACATCYARYACTGTYACTGAYTTKTTCTTTT (SEQ ID NO: 1954) |
| 101 | ACTGAYTTKTTCTTTT (SEQ ID NO: 1955) |
| 101 | GTYACTGAYTTKTTCTTTT (SEQ ID NO: 1956) |
| 101 | ACTGTYACTGAYTTKTTCTTTT (SEQ ID NO: 1957) |

TABLE 5 -continued

| | |
|---|---|
| 101 | DACTGARAARTATGCATCHCCYACATCYARBACTGTYACWGAYTTTTCTT (SEQ ID NO: 1958) |
| 101 | TCYARYACTGTYACTGAYTTKTTCTTTT + N (SEQ ID NO: 1959) |
| 101 | YACATCYARYACTGTYACTGAYTTKTTCTTTT + N (SEQ ID NO: 1960) |
| 101 | GCRTCHCCYACATCYARYACTGTYACTGAYTTKTTCTTTT + N (SEQ ID NO: 1961) |
| 101 | ACTGAYTTKTTCTTTT + N (SEQ ID NO: 1962) |
| 101 | GTYACTGAYTTKTTCTTTT + N (SEQ ID NO: 1963) |
| 101 | ACTGTYACTGAYTTKTTCTTTT + N (SEQ ID NO: 1964) |
| 101 | DACTGARAARTATGCATCHCCYACATCYARBACTGTYACWGAYTTTTCTT + N (SEQ ID NO: 1965) |
| 101 | +TCYARY + ACTGTY + ACTGAYTTKTTCTTTT (SEQ ID NO: 1966) |
| 101 | +TCYARYACT + GTY + ACTGAYTTKTTCTTTT (SEQ ID NO: 1967) |
| 101 | +TCYARY + ACT + GTYACTGAYTTKTTCTTTT (SEQ ID NO: 1968) |
| 101 | +YACA + TCYARYACT + GTYACTGAYTTKTTCTTTT (SEQ ID NO: 1969) |
| 101 | +YACATCYARY + ACT + GTYACTGAYTTKTTCTTTT (SEQ ID NO: 1970) |
| 101 | +YACA + TCYARY + ACTGTYACTGAYTTKTTCTTTT (SEQ ID NO: 1971) |
| 101 | +GCRTC + HCCYACA + TCYARYACTGTYACTGAYTTKTTCTTTT (SEQ ID NO: 1972) |
| 101 | +AC + TGAY + TTKTTCTTTT (SEQ ID NO: 1973) |
| 101 | +ACT + GAY + TTKTTCTTTT (SEQ ID NO: 1974) |
| 101 | +AC + T + GAYTTKTTCTTTT (SEQ ID NO: 1975) |
| 101 | +GTY + ACT + GAYTTKTTCTTTT (SEQ ID NO: 1976) |
| 101 | +GTYAC + T + GAYTTKTTCTTTT (SEQ ID NO: 1977) |
| 101 | +GTY + AC + TGAYTTKTTCTTTT (SEQ ID NO: 1978) |
| 101 | +ACT + GTYAC + TGAYTTKTTCTTTT (SEQ ID NO: 1979) |
| 101 | +ACTGTY + AC + TGAYTTKTTCTTTT (SEQ ID NO: 1980) |
| 101 | +ACT + GTY + ACTGAYTTKTTCTTTT (SEQ ID NO: 1981) |
| 101 | GCRTC + HCC + YACA + TCYARYACTGTYACTGAYTTKTTCTTTT (SEQ ID NO: 1982) |
| 103 | RTCHCCYACATCYARYACTGTYACTGAYTT (SEQ ID NO: 1983) |
| 103 | RTATGCRTCHCCYACATCYARYACTGTYACTGAYTT (SEQ ID NO: 1984) |
| 103 | ARAARTATGCRTCHCCYACATCYARYACTGTYACTGAYTT (SEQ ID NO: 1985) |
| 103 | CATCYARYACTGTYACTGAYTT (SEQ ID NO: 1986) |
| 103 | YACATCYARYACTGTYACTGAYTT (SEQ ID NO: 1987) |
| 103 | HCCYACATCYARYACTGTYACTGAYTT (SEQ ID NO: 1988) |
| 103 | MTAARGGDACTGARAARTATGCATCHCCYACATCYARBACTGTYACTGATTT (SEQ ID NO: 1989) |
| 103 | RTCHCCYACATCYARYACTGTYACTGAYTT + N (SEQ ID NO: 1990) |
| 103 | RTATGCRTCHCCYACATCYARYACTGTYACTGAYTT + N (SEQ ID NO: 1991) |
| 103 | ARAARTATGCRTCHCCYACATCYARYACTGTYACTGAYTT + N (SEQ ID NO: 1992) |
| 103 | CATCYARYACTGTYACTGAYTT + N (SEQ ID NO: 1993) |
| 103 | YACATCYARYACTGTYACTGAYTT + N (SEQ ID NO: 1994) |

TABLE 5 -continued

| | |
|---|---|
| 103 | HCCYACATCYARYACTGTYACTGAYTT + N (SEQ ID NO: 1995) |
| 103 | MTAARGGDACTGARAARTATGCATCHCCYACATCYARBACTGTYACTGATTT + N (SEQ ID NO: 1996) |
| 103 | +RTC + HCCYA + CATCYARYACTGTYACTGAYTT (SEQ ID NO: 1997) |
| 103 | +RTCHCC + YA + CATCYARYACTGTYACTGAYTT (SEQ ID NO: 1998) |
| 103 | +RTC + HCC + YACATCYARYACTGTYACTGAYTT (SEQ ID NO: 1999) |
| 103 | +RTATGC + RTCHCC + YACATCYARYACTGTYACTGAYTT (SEQ ID NO: 2000) |
| 103 | +RTATGCRTC + HCC + YACATCYARYACTGTYACTGAYTT (SEQ ID NO: 2001) |
| 103 | +RTATGC + RTC + HCCYACATCYARYACTGTYACTGAYTT (SEQ ID NO: 2002) |
| 103 | +ARAA + RTATGCRTC + HCCYACATCYARYACTGTYACTGAYTT (SEQ ID NO: 2003) |
| 103 | +ARAARTATGC + RTC + HCCYACATCYARYACTGTYACTGAYTT (SEQ ID NO: 2004) |
| 103 | +C + ATCYA + RYACTGTYACTGAYTT (SEQ ID NO: 2005) |
| 103 | +CATC + YA + RYACTGTYACTGAYTT (SEQ ID NO: 2006) |
| 103 | +C + ATC + YARYACTGTYACTGAYTT (SEQ ID NO: 2007) |
| 103 | +YA + CATC + YARYACTGTYACTGAYTT (SEQ ID NO: 2008) |
| 103 | +YAC + ATC + YARYACTGTYACTGAYTT (SEQ ID NO: 2009) |
| 103 | +YA + C + ATCYARYACTGTYACTGAYTT (SEQ ID NO: 2010) |
| 103 | +HCC + YAC + ATCYARYACTGTYACTGAYTT (SEQ ID NO: 2011) |
| 103 | +TCCYA + C + ATCYARYACTGTYACTGAYTT (SEQ ID NO: 2012) |
| 103 | +TCC + YA + CATCYARYACTGYACTGAYTT (SEQ ID NO: 2013) |
| 103 | +ARAA + RTATGC + RTCHCCYACATCYARYACTGTYACTGAYTT (SEQ ID NO: 2014) |
| 106 | ARAARTATGCRTCHCCYACATCYARYACTGTY (SEQ ID NO: 2015) |
| 106 | CTGARAARTATGCRTCHCCYACATCYARYACTGTY (SEQ ID NO: 2016) |
| 106 | RGGRACTGARAARTATGCRTCHCCYACATCYARYACTGTY (SEQ ID NO: 2017) |
| 106 | ATGCRTCHCCYACATCYARYACTGTY (SEQ ID NO: 2018) |
| 106 | ARTATGCRTCHCCYACATCYARYACTGTY (SEQ ID NO: 2019) |
| 106 | AARTATGCRTCHCCYACATCYARYACTGTY (SEQ ID NO: 2020) |
| 106 | DYYYTYATMTAARGGDACTGARAARTATGCATCHCCYACATCYARTACTGT (SEQ ID NO: 2021) |
| 106 | ARAARTATGCRTCHCCYACATCYARYACTGTY + N (SEQ ID NO: 2022) |
| 106 | CTGARAARTATGCRTCHCCYACATCYARYACTGTY + N (SEQ ID NO: 2023) |
| 106 | RGGRACTGARAARTATGCRTCHCCYACATCYARYACTGTY + N (SEQ ID NO: 2024) |
| 106 | ATGCRTCHCCYACATCYARYACTGTY + N (SEQ ID NO: 2025) |
| 106 | ARTATGCRTCHCCYACATCYARYACTGTY + N (SEQ ID NO: 2026) |
| 106 | AARTATGCRTCHCCYACATCYARYACTGTY + N (SEQ ID NO: 2027) |
| 106 | DYYYTYATMTAARGGDACTGARAARTATGCATCHCCYACATCYARTACTGT + N (SEQ ID NO: 2028) |
| 106 | +AR + AART + ATGCRTCHCCYACATCYARYACTGTY (SEQ ID NO: 2029) |
| 106 | +ARA + ART + ATGCRTCHCCYACATCYARYACTGTY (SEQ ID NO: 2030) |

TABLE 5 -continued

| | |
|---|---|
| 106 | +AR + A + ARTATGCRTCHCCYACATCYARYACTGTY (SEQ ID NO: 2031) |
| 106 | +CTG + ARA + ARTATGCRTCHCCYACATCYARYACTGTY (SEQ ID NO: 2032) |
| 106 | +CTGAR + A + ARTATGCRTCHCCYACATCYARYACTGTY (SEQ ID NO: 2033) |
| 106 | +CTG + AR + AARTATGCRTCHCCYACATCYARYACTGTY (SEQ ID NO: 2034) |
| 106 | RG + GRA + CTGAR + AARTATGCRTCHCCYACATCYARYACTGTY (SEQ ID NO: 2035) |
| 106 | RG + GRACTG + AR + AARTATGCRTCHCCYACATCYARYACTGTY (SEQ ID NO: 2036) |
| 106 | +AT + GCR + TCHCCYACATCYARYACTGTY (SEQ ID NO: 2037) |
| 106 | +ATG + CR + TCHCCYACATCYARYACTGTY (SEQ ID NO: 2038) |
| 106 | +AT + G + CRTCHCCYACATCYARYACTGTY (SEQ ID NO: 2039) |
| 106 | +ART + ATG + CRTCHCCYACATCYARYACTGTY (SEQ ID NO: 2040) |
| 106 | +ARTAT + G + CRTCHCCYACATCYARYACTGTY (SEQ ID NO: 2041) |
| 106 | +ART + AT + GCRTCHCCYACATCYARYACTGTY (SEQ ID NO: 2042) |
| 106 | +A + ARTAT + GCRTCHCCYACATCYARYACTGTY (SEQ ID NO: 2043) |
| 106 | +AART + AT + GCRTCHCCYACATCYARYACTGTY (SEQ ID NO: 2044) |
| 106 | +A + ART + ATGCRTCHCCYACATCYARYACTGTY (SEQ ID NO: 2045) |
| 106 | RG + GRA + CTG + ARAARTATGCRTCHCCYACATCYARYACTGTY (SEQ ID NO: 2046) |
| 108 | RGGRACTGARAARTATGCRTCHCCYACATCYARYA (SEQ ID NO: 2047) |
| 108 | AARGGRACTGARAARTATGCRTCHCCYACATCYARYA (SEQ ID NO: 2048) |
| 108 | TVTAARGGRACTGARAARTATGCRTCHCCYACATCYARYA (SEQ ID NO: 2049) |
| 108 | TGARAARTATGCRTCHCCYACATCYARYA (SEQ ID NO: 2050) |
| 108 | ACTGARAARTATGCRTCHCCYACATCYARYA (SEQ ID NO: 2051) |
| 108 | GGRACTGARAARTATGCRTCHCCYACATCYARYA (SEQ ID NO: 2052) |
| 108 | YCTRAADYYYTYATMTAARGGDACTGARAARTATGCATCHCCYACATCCAG (SEQ ID NO: 2053) |
| 108 | RGGRACTGARAARTATGCRTCHCCYACATCYARYA + N (SEQ ID NO: 2054) |
| 108 | AARGGRACTGARAARTATGCRTCHCCYACATCYARYA + N (SEQ ID NO: 2055) |
| 108 | TVTAARGGRACTGARAARTATGCRTCHCCYACATCYARYA + N (SEQ ID NO: 2056) |
| 108 | TGARAARTATGCRTCHCCYACATCYARYA + N (SEQ ID NO: 2057) |
| 108 | ACTGARAARTATGCRTCHCCYACATCYARYA + N (SEQ ID NO: 2058) |
| 108 | GGRACTGARAARTATGCRTCHCCYACATCYARYA + N (SEQ ID NO: 2059) |
| 108 | YCTRAADYYYTYATMTAARGGDACTGARAARTATGCATCHCCYACATCCAG + N (SEQ ID NO: 2060) |
| 108 | +R + GGRAC + TGARAARTATGCRTCHCCYACATCYARYA (SEQ ID NO: 2061) |
| 108 | +RGGR + AC + TGARAARTATGCRTCHCCYACATCYARYA (SEQ ID NO: 2062) |
| 108 | +R + GGR + ACTGARAARTATGCRTCHCCYACATCYARYA (SEQ ID NO: 2063) |
| 108 | +AA + RGGR + ACTGARAARTATGCRTCHCCYACATCYARYA (SEQ ID NO: 2064) |
| 108 | +AAR + GGR + ACTGARAARTATGCRTCHCCYACATCYARYA (SEQ ID NO: 2065) |

TABLE 5 -continued

| | |
|---|---|
| 108 | +AA + R + GGRACTGARAARTATGCRTCHCCYACATCYARYA (SEQ ID NO: 2066) |
| 108 | TVT + AA + RGGR + ACTGARAARTATGCRTCHCCYACATCYARYA (SEQ ID NO: 2067) |
| 108 | TVTAA + R + GGR + ACTGARAARTATGCRTCHCCYACATCYARYA (SEQ ID NO: 2068) |
| 108 | +T + GAR + AARTATGCRTCHCCYACATCYARYA (SEQ ID NO: 2069) |
| 108 | +TGA + R + AARTATGCRTCHCCYACATCYARYA (SEQ ID NO: 2070) |
| 108 | +T + GA + RAARTATGCRTCHCCYACATCYARYA (SEQ ID NO: 2071) |
| 108 | +AC + TGA + RAARTATGCRTCHCCYACATCYARYA (SEQ ID NO: 2072) |
| 108 | +ACT + GA + RAARTATGCRTCHCCYACATCYARYA (SEQ ID NO: 2073) |
| 108 | +AC + T + GARAARTATGCRTCHCCYACATCYARYA (SEQ ID NO: 2074) |
| 108 | +GGR + ACT + GARAARTATGCRTCHCCYACATCYARYA (SEQ ID NO: 2075) |
| 108 | +GGRAC + T + GARAARTATGCRTCHCCYACATCYARYA (SEQ ID NO: 2076) |
| 108 | +GGR + AC + TGARAARTATGCRTCHCCYACATCYARYA (SEQ ID NO: 2077) |
| 108 | +TVT + AA + RGGRACTGARAARTATGCRTCHCCYACATCYARYA (SEQ ID NO: 2078) |
| 115 | AYTTYCTRAADYYYTYATVTAARGGRACTGARAAR (SEQ ID NO: 2079) |
| 115 | TAYTTYCTRAADYYYTYATVTAARGGRACTGARAAR (SEQ ID NO: 2080) |
| 115 | AGTRTAYTTYCTRAADYYYTYATVTAARGGRACTGARAAR (SEQ ID NO: 2081) |
| 115 | TRAADYYYTYATVTAARGGRACTGARAAR (SEQ ID NO: 2082) |
| 115 | CTRAADYYYTYATVTAARGGRACTGARAAR (SEQ ID NO: 2083) |
| 115 | TYCTRAADYYYTYATVTAARGGRACTGARAAR (SEQ ID NO: 2084) |
| 115 | TATRGTRAATGCAGTRTAYTTYCTRAADYYYTYATMTAARGGDACTGAAAA (SEQ ID NO: 2085) |
| 115 | AYTTYCTRAADYYYTYATVTAARGGRACTGARAAR + N (SEQ ID NO: 2086) |
| 115 | TAYTTYCTRAADYYYTYATVTAARGGRACTGARAAR + N (SEQ ID NO: 2087) |
| 115 | AGTRTAYTTYCTRAADYYYTYATVTAARGGRACTGARAAR + N (SEQ ID NO: 2088) |
| 115 | TRAADYYYTYATVTAARGGRACTGARAAR + N (SEQ ID NO: 2089) |
| 115 | CTRAADYYYTYATVTAARGGRACTGARAAR + N (SEQ ID NO: 2090) |
| 115 | TYCTRAADYYYTYATVTAARGGRACTGARAAR + N (SEQ ID NO: 2091) |
| 115 | TATRGTRAATGCAGTRTAYTTYCTRAADYYYTYATMTAARGGDACTGAAAA + N (SEQ ID NO: 2092) |
| 115 | +AYT + TYC + TRAADYYYTYATVTAARGGRACTGARAAR (SEQ ID NO: 2093) |
| 115 | +AYTTY + C + TRAADYYYTYATVTAARGGRACTGARAAR (SEQ ID NO: 2094) |
| 115 | +AYT + TY + CTRAADYYYTYATVTAARGGRACTGARAAR (SEQ ID NO: 2095) |
| 115 | +T + AYTTY + CTRAADYYYTYATVTAARGGRACTGARAAR (SEQ ID NO: 2096) |
| 115 | +TAYT + TY + CTRAADYYYTYATVTAARGGRACTGARAAR (SEQ ID NO: 2097) |
| 115 | +T + AYT + TYCTRAADYYYTYATVTAARGGRACTGARAAR (SEQ ID NO: 2098) |
| 115 | A + GTR + TAYT + TYCTRAADYYYTYATVTAARGGRACTGARAAR (SEQ ID NO: 2099) |
| 115 | A + GTRT + AYT + TYCTRAADYYYTYATVTAARGGRACTGARAAR (SEQ ID NO: 2100) |
| 115 | +TRA + ADYYYTYATVTA + AGGGRACTGARAAR (SEQ ID NO: 2101) |
| 115 | +TRAADYYYTYATVT + A + ARGGRACTGARAAR (SEQ ID NO: 2102) |
| 115 | +TRA + ADYYYTYATVT + AARGGRACTGARAAR (SEQ ID NO: 2103) |

TABLE 5 -continued

| | |
|---|---|
| 115 | +C + TRAADYYYTYATVT + AARGGRACTGARAAR (SEQ ID NO: 2104) |
| 115 | +CTRA + ADYYYTYATVT + AARGGRACTGARAAR (SEQ ID NO: 2105) |
| 115 | +C + TRA + ADYYYTYATVTAARGGRACTGARAAR (SEQ ID NO: 2106) |
| 115 | +TY + CTRA + ADYYYTYATVTAARGGRACTGARAAR (SEQ ID NO: 2107) |
| 115 | +TYC + TRA + ADYYYTYATVTAARGGRACTGARAAR (SEQ ID NO: 2108) |
| 115 | +TY + C + TRAADYYYTYATVTAARGGRACTGARAAR (SEQ ID NO: 2109) |
| 115 | A + GTR + T + AYTTYCTRAADYYYTYATVTAARGGRACTGARAAR (SEQ ID NO: 2110) |
| 116 | TRTAYTTYCTRAADYYYTYATVTAARGGRACTGAR (SEQ ID NO: 2111) |
| 116 | CAGTRTAYTTYCTRAADYYYTYATVTAARGGRACTGAR (SEQ ID NO: 2112) |
| 116 | TGCAGTRTAYTTYCTRAADYYYTYATVTAARGGRACTGAR (SEQ ID NO: 2113) |
| 116 | TYCTRAADYYYTYATVTAARGGRACTGAR (SEQ ID NO: 2114) |
| 116 | AYTTYCTRAADYYYTYATVTAARGGRACTGAR (SEQ ID NO: 2115) |
| 116 | TAYTTYCTRAADYYYTYATVTAARGGRACTGAR (SEQ ID NO: 2116) |
| 116 | RGGTATRGTRAATGCAGTRTAYTTYCTRAADYYYTYATMTAARGGAACTGA (SEQ ID NO: 2117) |
| 116 | TRTAYTTYCTRAADYYYTYATVTAARGGRACTGAR + N (SEQ ID NO: 2118) |
| 116 | CAGTRTAYTTYCTRAADYYYTYATVTAARGGRACTGAR + N (SEQ ID NO: 2119) |
| 116 | TGCAGTRTAYTTYCTRAADYYYTYATVTAARGGRACTGAR + N (SEQ ID NO: 2120) |
| 116 | TYCTRAADYYYTYATVTAARGGRACTGAR + N (SEQ ID NO: 2121) |
| 116 | AYTTYCTRAADYYYTYATVTAARGGRACTGAR + N (SEQ ID NO: 2122) |
| 116 | TAYTTYCTRAADYYYTYATVTAARGGRACTGAR + N (SEQ ID NO: 2123) |
| 116 | RGGTATRGTRAATGCAGTRTAYTTYCTRAADYYYTYATMTAARGGAACTGA + N (SEQ ID NO: 2124) |
| 116 | +TR + TAYT + TYCTRAADYYYTYATVTAARGGRACTGAR (SEQ ID NO: 2125) |
| 116 | +TRT + AYT + TYCTRAADYYYTYATVTAARGGRACTGAR (SEQ ID NO: 2126) |
| 116 | +TR + T + AYTTYCTRAADYYYTYATVTAARGGRACTGAR (SEQ ID NO: 2127) |
| 116 | +CAG + TRT + AYTTYCTRAADYYYTYATVTAARGGRACTGAR (SEQ ID NO: 2128) |
| 116 | +CAGTR + T + AYTTYCTRAADYYYTYATVTAARGGRACTGAR (SEQ ID NO: 2129) |
| 116 | +CAG + TR + TAYTTYCTRAADYYYTYATVTAARGGRACTGAR (SEQ ID NO: 2130) |
| 116 | T + G + CAGTR + TAYTTYCTRAADYYYTYATVTAARGGRACTGAR (SEQ ID NO: 2131) |
| 116 | T + GCAG + TR + TAYTTYCTRAADYYYTYATVTAARGGRACTGAR (SEQ ID NO: 2132) |
| 116 | +TYCTRAADYYY + TVA + TVTAARGGRACTGAR (SEQ ID NO: 2133) |
| 116 | +TRYTRAADYYYT + YA + TVTAARGGRACTGAR (SEQ ID NO: 2134) |
| 116 | +TYCTRAADYYY + T + YATVTAARGGRACTGAR (SEQ ID NO: 2135) |
| 116 | +AYT + TYCTRAADYYYT + YATVTAARGGRACTGAR (SEQ ID NO: 2136) |
| 116 | +AYTTYCTRAADYYY + T + YATVTAARGGRACTGAR (SEQ ID NO: 2137) |
| 116 | +AYT + TYCTRAADYYY + TYATVTAARGGRACTGAR (SEQ ID NO: 2138) |
| 116 | +T + AYTTYCTRAADYYY + TVATVTAARGGRACTGAR (SEQ ID NO: 2139) |
| 116 | +TAYT + TYCTRAADYYY + TYATVTAARGGRACTGAR (SEQ ID NO: 2140) |
| 116 | +T + AYT + TYCTRAADYYYTYATVTAARGGRACTGAR (SEQ ID NO: 2141) |

TABLE 5 -continued

| | | |
|---|---|---|
| 116 | T + G + CAG + TRTAYTTYCTRAADYYYTYATVTAARGGRACTGAR (SEQ ID NO: 2142) | |
| 118 | AATGCAGTRTAYTTYCTRAADYYYTYATVTAARGGRA (SEQ ID NO: 2143) | |
| 118 | RAATGCAGTRTAYTTYCTRAADYYYTYATVTAARGGRA (SEQ ID NO: 2144) | |
| 118 | GTRAATGCAGTRTAYTTYCTRAADYYYTYATVTAARGGRA (SEQ ID NO: 2145) | |
| 118 | CTRAADYYYTYATVTAARGGRA (SEQ ID NO: 2146) | |
| 118 | YCTRAADYYYTYATVTAARGGRA (SEQ ID NO: 2147) | |
| 118 | GCAGTRTAYTTYCTRAADYYYTYATVTAARGGRA (SEQ ID NO: 2148) | |
| 118 | RYACTRGGTATRGTRAATGCAGTRTAYTTYCTRAADYYYTYATMTAAAGG (SEQ ID NO: 2149) | |
| 118 | AATGCAGTRTAYTTYCTRAADYYYTYATVTAARGGRA + N (SEQ ID NO: 2150) | |
| 118 | RAATGCAGTRTAYTTYCTRAADYYYTYATVTAARGGRA + N (SEQ ID NO: 2151) | |
| 118 | GTRAATGCAGTRTAYTTYCTRAADYYYTYATVTAARGGRA + N (SEQ ID NO: 2152) | |
| 118 | CTRAADYYYTYATVTAARGGRA + N (SEQ ID NO: 2153) | |
| 118 | YCTRAADYYYTYATVTAARGGRA + N (SEQ ID NO: 2154) | |
| 118 | GCAGTRTAYTTYCTRAADYYYTYATVTAARGGRA + N (SEQ ID NO: 2155) | |
| 118 | RYACTRGGTATRGTRAATGCAGTRTAYTTYCTRAADYYYTYATMTAAAGG + N (SEQ ID NO: 2156) | |
| 118 | +AAT + GCAGTRTAYTTY + CTRAADYYYTYATVTAARGGRA (SEQ ID NO: 2157) | |
| 118 | +AATGCAGTRTAYTT + Y + CTRAADYYYTYATVTAARGGRA (SEQ ID NO: 2158) | |
| 118 | +AAT + GCAGTRTAYTT + YCTRAADYYYTYATVTAARGGRA (SEQ ID NO: 2159) | |
| 118 | +R + AATGCAGTRTAYTT + YCTRAADYYYTYATVTAARGGRA (SEQ ID NO: 2160) | |
| 118 | +RAAT + GCAGTRTAYTT + YCTRAADYYYTYATVTAARGGRA (SEQ ID NO: 2161) | |
| 118 | +R + AAT + GCAGTRTAYTTYCTRAADYYYTYATVTAARGGRA (SEQ ID NO: 2162) | |
| 118 | +GT + RAAT + GCAGTRTAYTTYCTRAADYYYTYATVTAARGGRA (SEQ ID NO: 2163) | |
| 118 | +GTR + AAT + GCAGTRTAYTTYCTRAADYYYTYATVTAARGGRA (SEQ ID NO: 2164) | |
| 118 | +CT + RAA + DYYYTYATVTAARGGRA (SEQ ID NO: 2165) | |
| 118 | +CTR + AA + DYYYTYATVTAARGGRA (SEQ ID NO: 2166) | |
| 118 | +CT + R + AADYYYTYATVTAARGGRA (SEQ ID NO: 2167) | |
| 118 | +Y + CTR + AADYYYTYATVTAARGGRA (SEQ ID NO: 2168) | |
| 118 | +YCT + R + AADYYYTYATVTAARGGRA (SEQ ID NO: 2169) | |
| 118 | +Y + CT + RAADYYYTYATVTAARGGRA (SEQ ID NO: 2170) | |
| 118 | +GCAGTRTAYTT + YCT + RAADYYYTYATVTAARGGRA (SEQ ID NO: 2171) | |
| 118 | +GCAGTRTAYTTY + CT + RAADYYYTYATVTAARGGRA (SEQ ID NO: 2172) | |
| 118 | +GCAGTRTAYTT + Y + CTRAADYYYTYATVTAARGGRA (SEQ ID NO: 2173) | |
| 118 | +GT + R + AATGCAGTRTAYTTYCTRAADYYYTYATVTAARGGRA (SEQ ID NO: 2174) | |
| 138 | YACATTRTAYTGRTAYCTRAYYCCTGGTGTYT (SEQ ID NO: 2175) | |
| 138 | AGYACATTRTAYTGRTAYCTRAYYCCTGGTGTY (SEQ ID NO: 2176) | |
| 138 | AGYACATTRTAYTGRTAYCTRAYYCCTGGTGTYT (SEQ ID NO: 2177) | |
| 138 | GNAGYACATTRTAYTGRTAYCTRAYYCCTGGTGTY (SEQ ID NO: 2178) | |
| 138 | TGTGGNAGYACATTRTAYTGRTAYCTRAYYCCTGGTGTYT (SEQ ID NO: 2179) | |

TABLE 5 -continued

| | |
|---|---|
| 138 | YTGTGGNAGYACATTRTAYTGRTAYCTRAYYCCTGGTGTY (SEQ ID NO: 2180) |
| 138 | TAYTGRTAYCTRAYYCCTGGTGTYT (SEQ ID NO: 2181) |
| 138 | TRTAYTGRTAYCTRAYYCCTGGTGTY (SEQ ID NO: 2182) |
| 138 | RTAYTGRTAYCTRAYYCCTGGTGTYT (SEQ ID NO: 2183) |
| 138 | TTRTAYTGRTAYCTRAYYCCTGGTGTY (SEQ ID NO: 2184) |
| 138 | ACATTRTAYTGRTAYCTRAYYCCTGGTGTYT (SEQ ID NO: 2185) |
| 138 | GYACATTRTAYTGRTAYCTRAYYCCTGGTGTY (SEQ ID NO: 2186) |
| 138 | YCCTTTCCATCCYTGTGGVAGYACATTRTAYTGATAYCTRAYYCCTGGTGT (SEQ ID NO: 2187) |
| 138 | YACATTRTAYTGRTAYCTRAYYCCTGGTGTYT + N (SEQ ID NO: 2188) |
| 138 | AGYACATTRTAYTGRTAYCTRAYYCCTGGTGTY + N (SEQ ID NO: 2189) |
| 138 | AGYACATTRTAYTGRTAYCTRAYYCCTGGTGTYT + N (SEQ ID NO: 2190) |
| 138 | GNAGYACATTRTAYTGRTAYCTRAYYCCTGGTGTY + N (SEQ ID NO: 2191) |
| 138 | TGTGGNAGYACATTRTAYTGRTAYCTRAYYCCTGGTGTYT + N (SEQ ID NO: 2192) |
| 138 | YTGTGGNAGYACATTRTAYTGRTAYCTRAYYCCTGGTGTY + N (SEQ ID NO: 2193) |
| 138 | TAYTGRTAYCTRAYYCCTGGTGTYT + N (SEQ ID NO: 2194) |
| 138 | TRTAYTGRTAYCTRAYYCCTGGTGTY + N (SEQ ID NO: 2195) |
| 138 | RTAYTGRTAYCTRAYYCCTGGTGTYT + N (SEQ ID NO: 2196) |
| 138 | TTRTAYTGRTAYCTRAYYCCTGGTGTY + N (SEQ ID NO: 2197) |
| 138 | ACATTRTAYTGRTAYCTRAYYCCTGGTGTYT + N (SEQ ID NO: 2198) |
| 138 | GYACATTRTAYTGRTAYCTRAYYCCTGGTGTY + N (SEQ ID NO: 2199) |
| 138 | YCCTTTCCATCCYTGTGGVAGYACATTRTAYTGATAYCTRAYYCCTGGTGT + N (SEQ ID NO: 2200) |
| 138 | +Y + ACATTR + TAYTGRTAYCTRAYYCCTGGTGTYT (SEQ ID NO: 2201) |
| 138 | +A + GYACAT + TRTAYTGRTAYCTRAYYCCTGGTGTY (SEQ ID NO: 2202) |
| 138 | +YACATT + R + TAYTGRTAYCTRAYYCCTGGTGTYT (SEQ ID NO: 2203) |
| 138 | +AGYACA + T + TRTAYTGRTAYCTRAYYCCTGGTGTY (SEQ ID NO: 2204) |
| 138 | +Y + ACATT + RTAYTGRTAYCTRAYYCCTGGTGTYT (SEQ ID NO: 2205) |
| 138 | +A + GYACA + TTRTAYTGRTAYCTRAYYCCTGGTGTY (SEQ ID NO: 2206) |
| 138 | +AG + YACATT + RTAYTGRTAYCTRAYYCCTGGTGTYT (SEQ ID NO: 2207) |
| 138 | +GN + AGYACA + TTRTAYTGRTAYCTRAYYCCTGGTGTY (SEQ ID NO: 2208) |
| 138 | +AGY + ACATT + RTAYTGRTAYCTRAYYCCTGGTGTYT (SEQ ID NO: 2209) |
| 138 | +GNA + GYACA + TTRTAYTGRTAYCTRAYYCCTGGTGTY (SEQ ID NO: 2210) |
| 138 | +AG + Y + ACATTRTAYTGRTAYCTRAYYCCTGGTGTYT (SEQ ID NO: 2211) |
| 138 | +GN + A + GYACATTRTAYTGRTAYCTRAYYCCTGGTGTY (SEQ ID NO: 2212) |
| 138 | TGTGG + N + AGY + ACATTRTAYTGRTAYCTRAYYCCTGGTGTYT (SEQ ID NO: 2213) |
| 138 | YTGT + G + GNA + GYACATTRTAYTGRTAYCTRAYYCCTGGTGTY (SEQ ID NO: 2214) |
| 138 | TGTGG + NAG + Y + ACATTRTAYTGRTAYCTRAYYCCTGGTGTYT (SEQ ID NO: 2215) |
| 138 | YTGT + GGN + A + GYACATTRTAYTGRTAYCTRAYYCCTGGTGTY (SEQ ID NO: 2216) |
| 138 | +TA + YTGRTA + YCTRAYYCCTGGTGTYT (SEQ ID NO: 2217) |

TABLE 5 -continued

| | |
|---|---|
| 138 | +TR + TAYTGR + TAYCTRAYYCCTGGTGTY (SEQ ID NO: 2218) |
| 138 | +TAY + TGRTA + YCTRAYYCCTGGTGTYT (SEQ ID NO: 2219) |
| 138 | +TRT + AYTGR + TAYCTRAYYCCTGGTGTY (SEQ ID NO: 2220) |
| 138 | +TA + Y + TGRTAYCTRAYYCCTGGTGTYT (SEQ ID NO: 2221) |
| 138 | +TR + T + AYTGRTAYCTRAYYCCTGGTGTY (SEQ ID NO: 2222) |
| 138 | +R + TAY + TGRTAYCTRAYYCCTGGTGTYT (SEQ ID NO: 2223) |
| 138 | +T + TRT + AYTGRTAYCTRAYYCCTGGTGTY (SEQ ID NO: 2224) |
| 138 | +RTA + Y + TGRTAYCTRAYYCCTGGTGTYT (SEQ ID NO: 2225) |
| 138 | +TTR + T + AYTGRTAYCTRAYYCCTGGTGTY (SEQ ID NO: 2226) |
| 138 | +R + TA + YTGRTAYCTRAYYCCTGGTGTYT (SEQ ID NO: 2227) |
| 138 | +T + TR + TAYTGRTAYCTRAYYCCTGGTGTY (SEQ ID NO: 2228) |
| 138 | +ACATT + RTA + YTGRTAYCTRAYYCCTGGTGTYT (SEQ ID NO: 2229) |
| 138 | +GYACA + TTR + TAYTGRTAYCTRAYYCCTGGTGTY (SEQ ID NO: 2230) |
| 138 | +ACATTR + TA + YTGRTAYCTRAYYCCTGGTGTYT (SEQ ID NO: 2231) |
| 138 | +GYACAT + TR + TAYTGRTAYCTRAYYCCTGGTGTY (SEQ ID NO: 2232) |
| 138 | +ACATT + R + TAYTGRTAYCTRAYYCCTGGTGTYT (SEQ ID NO: 2233) |
| 138 | +GYACA + T + TRTAYTGRTAYCTRAYYCCTGGTGTY (SEQ ID NO: 2234) |
| 138 | TGTGG + N + AG + YACATTRTAYTGRTAYCTRAYYCCTGGTGTYT (SEQ ID NO: 2235) |
| 138 | YTGT + G + GN + AGYACATTRTAYTGRTAYCTRAYYCCTGGTGTY (SEQ ID NO: 2236) |
| 151 | TAARATTYTTGTCATRCTRSHYTGRAATATYGCYGGTGAYCCTTTCCATCC (SEQ ID NO: 2237) |
| 151 | TAARATTYTTGTCATRCTRSHYTGRAATATYGCYGGTGAYCCTTTCCATCC + N (SEQ ID NO: 2238) |
| 179 | CTACATAYAARTCATCCAYRTATTGRTARATV (SEQ ID NO: 2239) |
| 179 | ACATAYAARTCATCCAYRTATTGRTARATVA (SEQ ID NO: 2240) |
| 179 | CCTACATAYAARTCATCCAYRTATTGRTARATV (SEQ ID NO: 2241) |
| 179 | TACATAYAARTCATCCAYRTATTGRTARATVA (SEQ ID NO: 2242) |
| 179 | RTCWGAKCCTACATAYAARTCATCCAYRTATTGRTARATV (SEQ ID NO: 2243) |
| 179 | TCWGAKCCTACATAYAARTCATCCAYRTATTGRTARATVA (SEQ ID NO: 2244) |
| 179 | AYAARTCATCCAYRTATTGRTARATV (SEQ ID NO: 2245) |
| 179 | AARTCATCCAYRTATTGRTARATVA (SEQ ID NO: 2246) |
| 179 | CATAYAARTCATCCAYRTATTGRTARATV (SEQ ID NO: 2247) |
| 179 | TAYAARTCATCCAYRTATTGRTARATVA (SEQ ID NO: 2248) |
| 179 | ACATAYAARTCATCCAYRTATTGRTARATV (SEQ ID NO: 2249) |
| 179 | ATAYAARTCATCCAYRTATTGRTARATVA (SEQ ID NO: 2250) |
| 179 | YYCTATYTCTAARTCAGAYCCTACATAYAARTCATCCATRTAYTGATAGAT (SEQ ID NO: 2251) |
| 179 | CTACATAYAARTCATCCAYRTATTGRTARATV + N (SEQ ID NO: 2252) |
| 179 | ACATAYAARTCATCCAYRTATTGRTARATVA + N (SEQ ID NO: 2253) |
| 179 | CCTACATAYAARTCATCCAYRTATTGRTARATV + N (SEQ ID NO: 2254) |
| 179 | TACATAYAARTCATCCAYRTATTGRTARATVA + N (SEQ ID NO: 2255) |
| 179 | RTCWGAKCCTACATAYAARTCATCCAYRTATTGRTARATV + N (SEQ ID NO: 2256) |

TABLE 5 -continued

| | |
|---|---|
| 179 | TCWGAKCCTACATAYAARTCATCCAYRTATTGRTARATVA + N (SEQ ID NO: 2257) |
| 179 | AYAARTCATCCAYRTATTGRTARATV + N (SEQ ID NO: 2258) |
| 179 | AARTCATCCAYRTATTGRTARATVA + N (SEQ ID NO: 2259) |
| 179 | CATAYAARTCATCCAYRTATTGRTARATV + N (SEQ ID NO: 2260) |
| 179 | TAYAARTCATCCAYRTATTGRTARATVA + N (SEQ ID NO: 2261) |
| 179 | ACATAYAARTCATCCAYRTATTGRTARATV + N (SEQ ID NO: 2262) |
| 179 | ATAYAARTCATCCAYRTATTGRTARATVA + N (SEQ ID NO: 2263) |
| 179 | YYCTATYTCTAARTCAGAYCCTACATAYAARTCATCCATRTAYTGATAGAT + N (SEQ ID NO: 2264) |
| 179 | +CT + ACAT + AYAARTCATCCAYRTATTGRTARATV (SEQ ID NO: 2265) |
| 179 | +AC + ATAY + AARTCATCCAYRTATTGRTARATVA (SEQ ID NO: 2266) |
| 179 | +CTA + CAT + AYAARTCATCCAYRTATTGRTARATV (SEQ ID NO: 2267) |
| 179 | +ACA + TAY + AARTCATCCAYRTATTGRTARATVA (SEQ ID NO: 2268) |
| 179 | +CT + A + CATAYAARTCATCCAYRTATTGRTARATV (SEQ ID NO: 2269) |
| 179 | +AC + A + TAYAARTCATCCAYRTATTGRTARATVA (SEQ ID NO: 2270) |
| 179 | +C + CTA + CATAYAARTCATCCAYRTATTGRTARATV (SEQ ID NO: 2271) |
| 179 | +T + ACA + TAYAARTCATCCAYRTATTGRTARATVA (SEQ ID NO: 2272) |
| 179 | +CCT + A + CATAYAARTCATCCAYRTATTGRTARATV (SEQ ID NO: 2273) |
| 179 | +TAC + A + TAYAARTCATCCAYRTATTGRTARATVA (SEQ ID NO: 2274) |
| 179 | +C + CT + ACATAYAARTCATCCAYRTATTGRTARATV (SEQ ID NO: 2275) |
| 179 | +T + AC + ATAYAARTCATCCAYRTATTGRTARATVA (SEQ ID NO: 2276) |
| 179 | RT + CWGAK + CCT + ACATAYAARTCATCCAYRTATTGRTARATV (SEQ ID NO: 2277) |
| 179 | +TCW + GAKCCT + ACATAYAARTCATCCAYRTATTGRTARATVA (SEQ ID NO: 2278) |
| 179 | RT + CWGAKC + CT + ACATAYAARTCATCCAYRTATTGRTARATV (SEQ ID NO: 2279) |
| 179 | +AY + AA + RTCATCCAYRTATTGRTARATV (SEQ ID NO: 2280) |
| 179 | +AA + RT + CATCCAYRTATTGRTARATVA (SEQ ID NO: 2281) |
| 179 | +AYA + A + RTCATCCAYRTATTGRTARATV (SEQ ID NO: 2282) |
| 179 | +AAR + T + CATCCAYRTATTGRTARATVA (SEQ ID NO: 2283) |
| 179 | +AY + A + ARTCATCCAYRTATTGRTARATV (SEQ ID NO: 2284) |
| 179 | +AA + R + TCATCCAYRTATTGRTARATVA (SEQ ID NO: 2285) |
| 179 | +CAT + AYA + ARTCATCCAYRTATTGRTARATV (SEQ ID NO: 2286) |
| 179 | +TAY + AAR + TCATCCAYRTATTGRTARATVA (SEQ ID NO: 2287) |
| 179 | +CATAY + A + ARTCATCCAYRTATTGRTARATV (SEQ ID NO: 2288) |
| 179 | +TAYAA + R + TCATCCAYRTATTGRTARATVA (SEQ ID NO: 2289) |
| 179 | +CAT + AY + AARTCATCCAYRTATTGRTARATV (SEQ ID NO: 2290) |
| 179 | +TAY + AA + RTCATCCAYRTATTGRTARATVA (SEQ ID NO: 2291) |
| 179 | +A + CATAY + AARTCATCCAYRTATTGRTARATV (SEQ ID NO: 2292) |
| 179 | +A + TAYAA + RTCATCCAYRTATTGRTARATVA (SEQ ID NO: 2293) |
| 179 | +ACAT + AY + AARTCATCCAYRTATTGRTARATV (SEQ ID NO: 2294) |
| 179 | +ATAY + AA + RTCATCCAYRTATTGRTARATVA (SEQ ID NO: 2295) |

TABLE 5 -continued

| | |
|---|---|
| 179 | +A + CAT + AYAARTCATCCAYRTATTGRTARATV (SEQ ID NO: 2296) |
| 179 | +A + TAY + AARTCATCCAYRTATTGRTARATVA (SEQ ID NO: 2297) |
| 179 | RT + CWGAK + C + CTACATAYAARTCATCCAYRTATTGRTARATV (SEQ ID NO: 2298) |
| 179 | TCW + GAKCC + T + ACATAYAARTCATCCAYRTATTGRTARATVA (SEQ ID NO: 2299) |
| 181 | AARTCWGAKCCTACATAYAARTCATCCAYRTATTGR (SEQ ID NO: 2300) |
| 181 | CTAARTCWGAKCCTACATAYAARTCATCCAYRTATTGR (SEQ ID NO: 2301) |
| 181 | YTCTAARTCWGAKCCTACATAYAARTCATCCAYRTATTGR (SEQ ID NO: 2302) |
| 181 | GAKCCTACATAYAARTCATCCAYRTATTGR (SEQ ID NO: 2303) |
| 181 | CWGAKCCTACATAYAARTCATCCAYRTATTGR (SEQ ID NO: 2304) |
| 181 | ARTCWGAKCCTACATAYAARTCATCCAYRTATTGR (SEQ ID NO: 2305) |
| 181 | TRTGYTGYYCTATYTCTAARTCAGAYCCTACATAYAARTCATCCATGTATTG (SEQ ID NO: 2306) |
| 181 | AARTCWGAKCCTACATAYAARTCATCCAYRTATTGR + N (SEQ ID NO: 2307) |
| 181 | CTAARTCWGAKCCTACATAYAARTCATCCAYRTATTGR + N (SEQ ID NO: 2308) |
| 181 | YTCTAARTCWGAKCCTACATAYAARTCATCCAYRTATTGR + N (SEQ ID NO: 2309) |
| 181 | GAKCCTACATAYAARTCATCCAYRTATTGR + N (SEQ ID NO: 2310) |
| 181 | CWGAKCCTACATAYAARTCATCCAYRTATTGR + N (SEQ ID NO: 2311) |
| 181 | ARTCWGAKCCTACATAYAARTCATCCAYRTATTGR + N (SEQ ID NO: 2312) |
| 181 | TRTGYTGYYCTATYTCTAARTCAGAYCCTACATAYAARTCATCCATGTATTG + N (SEQ ID NO: 2313) |
| 181 | +A + ARTCW + GAKCCTACATAYAARTCATCCAYRTATTGR (SEQ ID NO: 2314) |
| 181 | +AART + CW + GAKCCTACATAYAARTCATCCAYRTATTGR (SEQ ID NO: 2315) |
| 181 | +A + ART + CWGAKCCTACATAYAARTCATCCAYRTATTGR (SEQ ID NO: 2316) |
| 181 | +CT + AART + CWGAKCCTACATAYAARTCATCCAYRTATTGR (SEQ ID NO: 2317) |
| 181 | +CTA + ART + CWGAKCCTACATAYAARTCATCCAYRTATTGR (SEQ ID NO: 2318) |
| 181 | +CT + A + ARTCWGAKCCTACATAYAARTCATCCAYRTATTGR (SEQ ID NO: 2319) |
| 181 | Y + T + CTA + ARTCWGAKCCTACATAYAARTCATCCAYRTATTGR (SEQ ID NO: 2320) |
| 181 | Y + TCT + A + ARTCWGAKCCTACATAYAARTCATCCAYRTATTGR (SEQ ID NO: 2321) |
| 181 | +G + AK + CCTACATAYAARTCATCCAYRTATTGR (SEQ ID NO: 2322) |
| 181 | +GA + K + CCTACATAYAARTCATCCAYRTATTGR (SEQ ID NO: 2323) |
| 181 | +G + A + KCCTACATAYAARTCATCCAYRTATTGR (SEQ ID NO: 2324) |
| 181 | +CW + GA + KCCTACATAYAARTCATCCAYRTATTGR (SEQ ID NO: 2325) |
| 181 | +CWG + A + KCCTACATAYAARTCATCCAYRTATTGR (SEQ ID NO: 2326) |
| 181 | +CW + G + AKCCTACATAYAARTCATCCAYRTATTGR (SEQ ID NO: 2327) |
| 181 | +ART + CWG + AKCCTACATAYAARTCATCCAYRTATTGR (SEQ ID NO: 2328) |
| 181 | +ARTCW + G + AKCCTACATAYAARTCATCCAYRTATTGR (SEQ ID NO: 2329) |
| 181 | +ART + CW + GAKCCTACATAYAARTCATCCAYRTATTGR (SEQ ID NO: 2330) |
| 181 | Y + T + CT + AARTCWGAKCCTACATAYAARTCATCCAYRTATTGR (SEQ ID NO: 2331) |
| 184 | YCTATYTCTAARTCWGAKCCTACATAYAARTCATCCA (SEQ ID NO: 2332) |
| 184 | TGYYCTATYTCTAARTCWGAKCCTACATAYAARTCATC (SEQ ID NO: 2333) |

TABLE 5 -continued

| | | |
|---|---|---|
| 184 | YYCTATYTCTAARTCWGAKCCTACATAYAARTCATCCA | (SEQ ID NO: 2334) |
| 184 | YTGYYCTATYTCTAARTCWGAKCCTACATAYAARTCATC | (SEQ ID NO: 2335) |
| 184 | TGYYCTATYTCTAARTCWGAKCCTACATAYAARTCATCCA | (SEQ ID NO: 2336) |
| 184 | GYTGYYCTATYTCTAARTCWGAKCCTACATAYAARTCATC | (SEQ ID NO: 2337) |
| 184 | ATYTCTAARTCWGAKCCTACATAYAARTCATCCA | (SEQ ID NO: 2338) |
| 184 | TATYTCTAARTCWGAKCCTACATAYAARTCATC | (SEQ ID NO: 2339) |
| 184 | TATYTCTAARTCWGAKCCTACATAYAARTCATCCA | (SEQ ID NO: 2340) |
| 184 | YYCTATYTCTAARTCWGAKCCTACATAYAARTCATC | (SEQ ID NO: 2341) |
| 184 | CTATYTCTAARTCWGAKCCTACATAYAARTCATCCA | (SEQ ID NO: 2342) |
| 184 | GYYCTATYTCTAARTCWGAKCCTACATAYAARTCATC | (SEQ ID NO: 2343) |
| 184 | TTTRYTCTRTGYTGYYCTATYTCTAARTCAGAYCCTACATAYAARTCATC (SEQ ID NO: 2344) | |
| 184 | YCTATYTCTAARTCWGAKCCTACATAYAARTCATCCA + N | (SEQ ID NO: 2345) |
| 184 | TGYYCTATYTCTAARTCWGAKCCTACATAYAARTCATC + N | (SEQ ID NO: 2346) |
| 184 | YYCTATYTCTAARTCWGAKCCTACATAYAARTCATCCA + N | (SEQ ID NO: 2347) |
| 184 | YTGYYCTATYTCTAARTCWGAKCCTACATAYAARTCATC + N (SEQ ID NO: 2348) | |
| 184 | TGYYCTATYTCTAARTCWGAKCCTACATAYAARTCATCCA + N | (SEQ ID NO: 2349) |
| 184 | GYTGYYCTATYTCTAARTCWGAKCCTACATAYAARTCATC + N | (SEQ ID NO: 2350) |
| 184 | ATYTCTAARTCWGAKCCTACATAYAARTCATCCA + N | (SEQ ID NO: 2351) |
| 184 | TATYTCTAARTCWGAKCCTACATAYAARTCATC + N | (SEQ ID NO: 2352) |
| 184 | TATYTCTAARTCWGAKCCTACATAYAARTCATCCA + N | (SEQ ID NO: 2353) |
| 184 | YYCTATYTCTAARTCWGAKCCTACATAYAARTCATC + N | (SEQ ID NO: 2354) |
| 184 | CTATYTCTAARTCWGAKCCTACATAYAARTCATCCA + N | (SEQ ID NO: 2355) |
| 184 | GYYCTATYTCTAARTCWGAKCCTACATAYAARTCATC + N | (SEQ ID NO: 2356) |
| 184 | TTTRYTCTRTGYTGYYCTATYTCTAARTCAGAYCCTACATAYAARTCATC + N (SEQ ID NO: 2357) | |
| 184 | +Y + CT + ATYTCTAARTCWGAKCCTACATAYAARTCATCCA | (SEQ ID NO: 2358) |
| 184 | | (SEQ ID NO: 2359) |
| 184 | +YC + T + ATYTCTAARTCWGAKCCTACATAYAARTCATCCA | (SEQ ID NO: 2360) |
| 184 | +TG + YYC + TATYTCTAARTCWGAKCCTACATAYAARTCATC (SEQ ID NO: 2361) | |
| 184 | +Y + C + TATYTCTAARTCWGAKCCTACATAYAARTCATCCA (SEQ ID NO: 2362) | |
| 184 | +T + G + YYCTATYTCTAARTCWGAKCCTACATAYAARTCATC | (SEQ ID NO: 2363) |
| 184 | +Y + YC + TATYTCTAARTCWGAKCCTACATAYAARTCATCCA (SEQ ID NO: 2364) | |
| 184 | +Y + TG + YYCTATYTCTAARTCWGAKCCTACATAYAARTCATC | (SEQ ID NO: 2365) |
| 184 | +YY + C + TATYTCTAARTCWGAKCCTACATAYAARTCATCCA | (SEQ ID NO: 2366) |
| 184 | +YT + G + YYCTATYTCTAARTCWGAKCCTACATAYAARTCATC | (SEQ ID NO: 2367) |
| 184 | +Y + Y + CTATYTCTAARTCWGAKCCTACATAYAARTCATCCA | (SEQ ID NO: 2368) |
| 184 | +Y + T + GYYCTATYTCTAARTCWGAKCCTACATAYAARTCATC | (SEQ ID NO: 2369) |
| 184 | TG + Y + YC + TATYTCTAARTCWGAKCCTACATAYAARTCATCCA | (SEQ ID NO: 2370) |

TABLE 5 -continued

| 184 | +G + YT + GYYCTATYTCTAARTCWGAKCCTACATAYAARTCATC (SEQ ID NO: 2371) |
| --- | --- |
| 184 | TGY + Y + C + TATYTCTAARTCWGAKCCTACATAYAARTCATCCA (SEQ ID NO: 2372) |
| 184 | +GY + T + GYYCTATYTCTAARTCWGAKCCTACATAYAARTCATC (SEQ ID NO: 2373) |
| 184 | +ATY + TCTAARTCWGA + KCCTACATAYAARTCATCCA (SEQ ID NO: 2374) |
| 184 | +TATYTC + TAARTC + WGAKCCTACATAYAARTCATC (SEQ ID NO: 2375) |
| 184 | +ATYTCTAAR + TCWGA + KCCTACATAYAARTCATCCA (SEQ ID NO: 2376) |
| 184 | +TATYTCTAART + C + WGAKCCTACATAYAARTCATC (SEQ ID NO: 2377) |
| 184 | +ATY + TCTAAR + TCWGAKCCTACATAYAARTCATCCA (SEQ ID NO: 2378) |
| 184 | +TATYTC + TAART + CWGAKCCTACATAYAARTCATC (SEQ ID NO: 2379) |
| 184 | +T + ATYTCTAAR + TCWGAKCCTACATAYAARTCATCCA (SEQ ID NO: 2380) |
| 184 | +YYC + TATYTCTAART + CWGAKCCTACATAYAARTCATC (SEQ ID NO: 2381) |
| 184 | +TATY + TCTAAR + TCWGAKCCTACATAYAARTCATCCA (SEQ ID NO: 2382) |
| 184 | +YYCTATYTC + TAART + CWGAKCCTACATAYAARTCATC (SEQ ID NO: 2383) |
| 184 | +T + ATY + TCTAARTCWGAKCCTACATAYAARTCATCCA (SEQ ID NO: 2384) |
| 184 | +YYC + TATYTC + TAARTCWGAKCCTACATAYAARTCATC (SEQ ID NO: 2385) |
| 184 | +C + TATY + TCTAART CWGAKCCTACATAYAARTCATCCA (SEQ ID NO: 2386) |
| 184 | +G + YYCTATYTC + TAARTCWGAKCCTACATAYAARTCATC (SEQ ID NO: 2387) |
| 184 | +CT + ATY + TCTAARTCWGAKCCTACATAYAARTCATCCA (SEQ ID NO: 2388) |
| 184 | +GYYC + TATYTC + TAARTCWGAKCCTACATAYAARTCATC (SEQ ID NO: 2389) |
| 184 | +C + T + ATYTCTAARTCWGAKCCTACATAYAARTCATCCA (SEQ ID NO: 2390) |
| 184 | +G + YYC + TATYTCTAARTCWGAKCCTACATAYAARTCATC (SEQ ID NO: 2391) |
| 184 | +TG + Y + YCTATYTCTAARTCWGAKCCTACATAYAARTCATCCA (SEQ ID NO: 2392) |
| 184 | +G + Y + TGYYCTATYTCTAARTCWGAKCCTACATAYAARTCATC (SEQ ID NO: 2393) |
| 188 | TRTGYTGYYCTATYTCTAARTCWGAKCCTACA (SEQ ID NO: 2394) |
| 188 | TGYTGYYCTATYTCTAARTCWGAKCCTACAT (SEQ ID NO: 2395) |
| 188 | CTRTGYTGYYCTATYTCTAARTCWGAKCCTACA (SEQ ID NO: 2396) |
| 188 | RTGYTGYYCTATYTCTAARTCWGAKCCTACAT (SEQ ID NO: 2397) |
| 188 | TTTTRYTCTRTGYTGYYCTATYTCTAARTCWGAKCCTACA (SEQ ID NO: 2398) |
| 188 | TTTRYTCTRTGYTGYYCTATYTCTAARTCWGAKCCTACAT (SEQ ID NO: 2399) |
| 188 | GYYCTATYTCTAARTCWGAKCCTACA (SEQ ID NO: 2400) |
| 188 | YCTATYTCTAARTCWGAKCCTACAT (SEQ ID NO: 2401) |
| 188 | GYTGYYCTATYTCTAARTCWGAKCCTACA (SEQ ID NO: 2402) |
| 188 | TGYYCTATYTCTAARTCWGAKCCTACAT (SEQ ID NO: 2403) |
| 188 | TGYTGYYCTATYTCTAARTCWGAKCCTACA (SEQ ID NO: 2404) |
| 188 | YTGYYCTATYTCTAARTCWGAKCCTACAT (SEQ ID NO: 2405) |
| 188 | YARYTCYTCTAYTTTTRYTCTRTGYTGYYCTATYTCTAARTCAGATCCTAC (SEQ ID NO: 2406) |
| 188 | TRTGYTGYYCTATYTCTAARTCWGAKCCTACA + N (SEQ ID NO: 2407) |
| 188 | TGYTGYYCTATYTCTAARTCWGAKCCTACAT + N (SEQ ID NO: 2408) |
| 188 | CTRTGYTGYYCTATYTCTAARTCWGAKCCTACA + N (SEQ ID NO: 2409) |

TABLE 5 -continued

| | | |
|---|---|---|
| 188 | RTGYTGYYCTATYTCTAARTCWGAKCCTACAT + N (SEQ ID NO: 2410) | |
| 188 | TTTTRYTCTRTGYTGYYCTATYTCTAARTCWGAKCCTACA + N (SEQ ID NO: 2411) | |
| 188 | TTTRYTCTRTGYTGYYCTATYTCTAARTCWGAKCCTACAT + N (SEQ ID NO: 2412) | |
| 188 | GYYCTATYTCTAARTCWGAKCCTACA + N (SEQ ID NO: 2413) | |
| 188 | YCTATYTCTAARTCWGAKCCTACAT + N (SEQ ID NO: 2414) | |
| 188 | GYTGYYCTATYTCTAARTCWGAKCCTACA + N (SEQ ID NO: 2415) | |
| 188 | TGYYCTATYTCTAARTCWGAKCCTACAT + N (SEQ ID NO: 2416) | |
| 188 | TGYTGYYCTATYTCTAARTCWGAKCCTACA + N (SEQ ID NO: 2417) | |
| 188 | YTGYYCTATYTCTAARTCWGAKCCTACAT + N (SEQ ID NO: 2418) | |
| 188 | YARYTCYTCTAYTTTTRYTCTRTGYTGYYCTATYTCTAARTCAGATCCTAC + N (SEQ ID NO: 2419) | |
| 188 | +TR + TGYT + GYYCTATYTCTAARTCWGAKCCTACA (SEQ ID NO: 2420) | |
| 188 | +TG + YTGY + YCTATYTCTAARTCWGAKCCTACAT (SEQ ID NO: 2421) | |
| 188 | +TRT + GYT + GYYCTATYTCTAARTCWGAKCCTACA (SEQ ID NO: 2422) | |
| 188 | +TGY + TGY + YCTATYTCTAARTCWGAKCCTACAT (SEQ ID NO: 2423) | |
| 188 | +TR + T + GYTGYYCTATYTCTAARTCWGAKCCTACA (SEQ ID NO: 2424) | |
| 188 | +TG + Y + TGYYCTATYTCTAARTCWGAKCCTACAT (SEQ ID NO: 2425) | |
| 188 | +C + TRT + GYTGYYCTATYTCTAARTCWGAKCCTACA (SEQ ID NO: 2426) | |
| 188 | +R + TGY + TGYYCTATYTCTAARTCWGAKCCTACAT (SEQ ID NO: 2427) | |
| 188 | +CTR + T + GYTGYYCTATYTCTAARTCWGAKCCTACA (SEQ ID NO: 2428) | |
| 188 | +RTG + Y + TGYYCTATYTCTAARTCWGAKCCTACAT (SEQ ID NO: 2429) | |
| 188 | +C + TR + TGYTGYYCTATYTCTAARTCWGAKCCTACA (SEQ ID NO: 2430) | |
| 188 | +R + TG + YTGYYCTATYTCTAARTCWGAKCCTACAT (SEQ ID NO: 2431) | |
| 188 | TT + TTRYT + CTR + TGYTGYYCTATYTCTAARTCWGAKCCTACA (SEQ ID NO: 2432) | |
| 188 | TTT + RYTCT + RTG + YTGYYCTATYTCTAARTCWGAKCCTACAT (SEQ ID NO: 2433) | |
| 188 | TT + TTRYTC + TR + TGYTGYYCTATYTCTAARTCWGAKCCTACA (SEQ ID NO: 2434) | |
| 188 | TTT + RYTCTR + TG + YTGYYCTATYTCTAARTCWGAKCCTACAT (SEQ ID NO: 2435) | |
| 188 | +GYY + CTATYTCTAART + CWGAKCCTACA (SEQ ID NO: 2436) | |
| 188 | +YCT + ATYTCTAARTCW + GAKCCTACAT (SEQ ID NO: 2437) | |
| 188 | +GYYCTATYTCTAAR + T + CWGAKCCTACA (SEQ ID NO: 2438) | |
| 188 | +YCTATYTCTAARTC + W + GAKCCTACAT (SEQ ID NO: 2439) | |
| 188 | +GYY + CTATYTCTAAR + TCWGAKCCTACA (SEQ ID NO: 2440) | |
| 188 | +YCT + ATYTCTAARTC + WGAKCCTACAT (SEQ ID NO: 2441) | |
| 188 | +GYT + GYYCTATYTCTAAR + TCWGAKCCTACA (SEQ ID NO: 2442) | |
| 188 | +TGY + YCTATYTCTAARTC + WGAKCCTACAT (SEQ ID NO: 2443) | |
| 188 | +GYTGYY + CTATYTCTAAR + TCWGAKCCTACA (SEQ ID NO: 2444) | |
| 188 | +TGYYCT + ATYTCTAARTC + WGAKCCTACAT (SEQ ID NO: 2445) | |
| 188 | +GYT + GYY + CTATYTCTAARTCWGAKCCTACA (SEQ ID NO: 2446) | |
| 188 | +TGY + YCT + ATYTCTAARTCWGAKCCTACAT (SEQ ID NO: 2447) | |
| 188 | +T + GYTGYY + CTATYTCTAARTCWGAKCCTACA (SEQ ID NO: 2448) | |
| 188 | +Y + TGYYCT + ATYTCTAARTCWGAKCCTACAT (SEQ ID NO: 2449) | |

TABLE 5 -continued

| | |
|---|---|
| 188 | +TGYT + GYY + CTATYTCTAARTCWGAKCCTACA (SEQ ID NO: 2450) |
| 188 | +YTGY + YCT + ATYTCTAARTCWGAKCCTACAT (SEQ ID NO: 2451) |
| 188 | +T + GYT + GYYCTATYTCTAARTCWGAKCCTACA (SEQ ID NO: 2452) |
| 188 | +Y + TGY + YCTATYTCTAARTCWGAKCCTACAT (SEQ ID NO: 2453) |
| 188 | TT + TTRYT + C + TRTGYTGYYCTATYTCTAARTCWGAKCCTACA (SEQ ID NO: 2454) |
| 188 | TTT + RYTCT + R + TGYTGYYCTATYTCTAARTCWGAKCCTACAT (SEQ ID NO: 2455) |
| 190 | AYTTTTRYTCTRTGYTGYYCTATYTCTAARTCWGAK (SEQ ID NO: 2456) |
| 190 | TTTTRYTCTRTGYTGYYCTATYTCTAARTCWGAKC (SEQ ID NO: 2457) |
| 190 | CTAYTTTTRYTCTRTGYTGYYCTATYTCTAARTCWGAK (SEQ ID NO: 2458) |
| 190 | AYTTTTRYTCTRTGYTGYYCTATYTCTAARTCWGAKC (SEQ ID NO: 2459) |
| 190 | YTCTAYTTTTRYTCTRTGYTGYYCTATYTCTAARTCWGAK (SEQ ID NO: 2460) |
| 190 | TCTAYTTTTRYTCTRTGYTGYYCTATYTCTAARTCWGAKC (SEQ ID NO: 2461) |
| 190 | YTCTRTGYTGYYCTATYTCTAARTCWGAK (SEQ ID NO: 2462) |
| 190 | CTRTGYTGYYCTATYTCTAARTCWGAKC (SEQ ID NO: 2463) |
| 190 | TTRYTCTRTGYTGYYCTATYTCTAARTCWGAK (SEQ ID NO: 2464) |
| 190 | RYTCTRTGYTGYYCTATYTCTAARTCWGAKC (SEQ ID NO: 2465) |
| 190 | YTTTTRYTCTRTGYTGYYCTATYTCTAARTCWGAK (SEQ ID NO: 2466) |
| 190 | TTTRYTCTRTGYTGYYCTATYTCTAARTCWGAKC (SEQ ID NO: 2467) |
| 190 | HKBYCTYARYTCYTCTAYTTTTRYTCTRTGYTGYYCTATYTCTAAGTCAGA (SEQ ID NO: 2468) |
| 190 | AYTTTTRYTCTRTGYTGYYCTATYTCTAARTCWGAK + N (SEQ ID NO: 2469) |
| 190 | TTTTRYTCTRTGYTGYYCTATYTCTAARTCWGAKC + N (SEQ ID NO: 2470) |
| 190 | CTAYTTTTRYTCTRTGYTGYYCTATYTCTAARTCWGAK + N (SEQ ID NO: 2471) |
| 190 | AYTTTTRYTCTRTGYTGYYCTATYTCTAARTCWGAKC + N (SEQ ID NO: 2472) |
| 190 | YTCTAYTTTTRYTCTRTGYTGYYCTATYTCTAARTCWGAK + N (SEQ ID NO: 2473) |
| 190 | TCTAYTTTTRYTCTRTGYTGYYCTATYTCTAARTCWGAKC + N (SEQ ID NO: 2474) |
| 190 | YTCTRTGYTGYYCTATYTCTAARTCWGAK + N (SEQ ID NO: 2475) |
| 190 | CTRTGYTGYYCTATYTCTAARTCWGAKC + N (SEQ ID NO: 2476) |
| 190 | TTRYTCTRTGYTGYYCTATYTCTAARTCWGAK + N (SEQ ID NO: 2477) |
| 190 | RYTCTRTGYTGYYCTATYTCTAARTCWGAKC + N (SEQ ID NO: 2478) |
| 190 | YTTTTRYTCTRTGYTGYYCTATYTCTAARTCWGAK + N (SEQ ID NO: 2479) |
| 190 | TTTRYTCTRTGYTGYYCTATYTCTAARTCWGAKC + N (SEQ ID NO: 2480) |
| 190 | HKBYCTYARYTCYTCTAYTTTTRYTCTRTGYTGYYCTATYTCTAAGTCAGA + N (SEQ ID NO: 2481) |
| 190 | +A + YTTTTR + YTCTRTGYTGYYCTATYTCTAARTCWGAK (SEQ ID NO: 2482) |
| 190 | +T + TTTRYT + CTRTGYTGYYCTATYTCTAARTCWGAKC (SEQ ID NO: 2483) |
| 190 | +AYTT + TTR + YTCTRTGYTGYYCTATYTCTAARTCWGAK (SEQ ID NO: 2484) |
| 190 | +TTTT + RYT + CTRTGYTGYYCTATYTCTAARTCWGAKC (SEQ ID NO: 2485) |

TABLE 5 -continued

| | |
|---|---|
| 190 | +A + YTT + TTRYTCTRTGYTGYYCTATYTCTAARTCWGAK (SEQ ID NO: 2486) |
| 190 | +T + TTT + TRYCTRTGYTGYYCTATYTCTAARTCWGAKC (SEQ ID NO: 2487) |
| 190 | +CT + AYTT + TTRYTCTRTGYTGYYCTATYTCTAARTCWGAK (SEQ ID NO: 2488) |
| 190 | +AY + TTTT + RYTCTRTGYTGYYCTATYTCTAARTCWGAKC (SEQ ID NO: 2489) |
| 190 | +CTA + YTT + TTRYTCTRTGYTGYYCTATYTCTAARTCWGAK (SEQ ID NO: 2490) |
| 190 | +AYT + TTT + RYTCTRTGYTGYYCTATYTCTAARTCWGAKC (SEQ ID NO: 2491) |
| 190 | +CT + A + YTTTTRYTCTRTGYTGYYCTATYTCTAARTCWGAK (SEQ ID NO: 2492) |
| 190 | +AY + T + TTTRYTCTRTGYTGYYCTATYTCTAARTCWGAKC (SEQ ID NO: 2493) |
| 190 | Y + T + CTA + YTTTTRYTCTRTGYTGYYCTATYTCTAARTCWGAK (SEQ ID NO: 2494) |
| 190 | TC + T + AYT + TTTRYTCTRTGYTGYYCTATYTCTAARTCWGAKC (SEQ ID NO: 2495) |
| 190 | Y + TCT + A + YTTTTRYTCTRTGYTGYYCTATYTCTAARTCWGAK (SEQ ID NO: 2496) |
| 190 | TC + TAY + T + TTTRYTCTRTGYTGYYCTATYTCTAARTCWGAKC (SEQ ID NO: 2497) |
| 190 | +YTCTRTGYTGY + YCT + ATYTCTAARTCWGAK (SEQ ID NO: 2498) |
| 190 | +CTRTGYTGYYC + TAT + YTCTAARTCWGAKC (SEQ ID NO: 2499) |
| 190 | +YTCTRTGYTGYY + CT + ATYTCTAARTCWGAK (SEQ ID NO: 2500) |
| 190 | +CTRTGYTGYYCT + AT + YTCTAARTCWGAKC (SEQ ID NO: 2501) |
| 190 | +YTCTRTGYTGY + Y + CTATYTCTAARTCWGAK (SEQ ID NO: 2502) |
| 190 | +CTRTGYTGYYC + T + ATYTCTAARTCWGAKC (SEQ ID NO: 2503) |
| 190 | +TTR + YTCTRTGYTGYY + CTATYTCTAARTCWGAK (SEQ ID NO: 2504) |
| 190 | +RYT + CTRTGYTGYYCT + ATYTCTAARTCWGAKC (SEQ ID NO: 2505) |
| 190 | +TTRYTCTRTGYTGY + Y + CTATYTCTAARTCWGAK (SEQ ID NO: 2506) |
| 190 | +RYTCTRTGYTGYYC + T + ATYTCTAARTCWGAKC (SEQ ID NO: 2507) |
| 190 | +TTR + YTCTRTGYTGY + YCTATYTCTAARTCWGAK (SEQ ID NO: 2508) |
| 190 | +RYT + CTRTGYTGYYC + TATYTCTAARTCWGAKC (SEQ ID NO: 2509) |
| 190 | +YTT + TTRYTCTRTGYTGY + YCTATYTCTAARTCWGAK (SEQ ID NO: 2510) |
| 190 | +TTT + RYTCTRTGYTGYYC + TATYTCTAARTCWGAKC (SEQ ID NO: 2511) |
| 190 | +YTTTTR + YTCTRTGYTGY + YCTATYTCTAARTCWGAK (SEQ ID NO: 2512) |
| 190 | +TTTRYT + CTRTGYTGYYC + TATYTCTAARTCWGAKC (SEQ ID NO: 2513) |
| 190 | +YTT + TTR + YTCTRTGYTGYYCTATYTCTAARTCWGAK (SEQ ID NO: 2514) |
| 190 | +TTT + RYT + CTRTGYTGYYCTATYTCTAARTCWGAKC (SEQ ID NO: 2515) |
| 190 | Y + T + CT + AYTTTTRYTCTRTGYTGYYCTATYTCTAARTCWGAK (SEQ ID NO: 2516) |
| 190 | TC + T + AY + TTTTRYTCTRTGYTGYYCTATYTCTAARTCWGAKC (SEQ ID NO: 2517) |
| 210 | ATGYTTYTTRTCTGGTGTRGWRARYCCCCABYTY (SEQ ID NO: 2518) |
| 210 | GATGYTTYTTRTCTGGTGTRGWRARYCCCCABYTY (SEQ ID NO: 2519) |
| 210 | YTTYTGATGYTTYTTRTCTGGTGTRGWRARYCCCCABYTY (SEQ ID NO: 2520) |
| 210 | TYTTRTCTGGTGTRGWRARYCCCCABYTY (SEQ ID NO: 2521) |
| 210 | GYTTYTTRTCTGGTGTRGWRARYCCCCABYTY (SEQ ID NO: 2522) |
| 210 | TGYTTYTTRTCTGGTGTRGWRARYCCCCABYTY (SEQ ID NO: 2523) |
| 210 | RAATGGRGGTTCYTTYTGATGYTTYTTRTCTGGKGTRKWRARYCCCCACCT (SEQ ID NO: 2524) |
| 210 | ATGYTTYTTRTCTGGTGTRGWRARYCCCCABYTY + N (SEQ ID NO: 2525) |

TABLE 5 -continued

| | |
|---|---|
| 210 | GATGYTTYTTRTCTGGTGTRGWRARYCCCCABYTY + N (SEQ ID NO: 2526) |
| 210 | YTTYTGATGYTTYTTRTCTGGTGTRGWRARYCCCCABYTY + N (SEQ ID NO: 2527) |
| 210 | TYTTRTCTGGTGTRGWRARYCCCCABYTY + N (SEQ ID NO: 2528) |
| 210 | GYTTYTTRTCTGGTGTRGWRARYCCCCABYTY + N (SEQ ID NO: 2529) |
| 210 | TGYTTYTTRTCTGGTGTRGWRARYCCCCABYTY + N (SEQ ID NO: 2530) |
| 210 | RAATGGRGGTTCYTTYTGATGYTTYTTRTCTGGKGTRKWRARYCCCCACCT + N (SEQ ID NO: 2531) |
| 210 | +A + TGYT + TYTTRTCTGGTGTRGWRARYCCCCABYTY (SEQ ID NO: 2532) |
| 210 | +AT + GYT + TYTTRTCTGGTGTRGWRARYCCCCABYTY (SEQ ID NO: 2533) |
| 210 | +A + T + GYTTYTTRTCTGGTGTRGWRARYCCCCABYTY (SEQ ID NO: 2534) |
| 210 | +G + AT + GYTTYTTRTCTGGTGTRGWRARYCCCCABYTY (SEQ ID NO: 2535) |
| 210 | +GA + T + GYTTYTTRTCTGGTGTRGWRARYCCCCABYTY (SEQ ID NO: 2536) |
| 210 | +G + A + TGYTTYTTRTCTGGTGTRGWRARYCCCCABYTY (SEQ ID NO: 2537) |
| 210 | YTTY + T + GA + TGYTTYTTRTCTGGTGTRGWRARYCCCCABYTY (SEQ ID NO: 2538) |
| 210 | YTTY + TG + A + TGYTTYTTRTCTGGTGTRGWRARYCCCCABYTY (SEQ ID NO: 2539) |
| 210 | +TYTTR + TCT + GGTGTRGWRARYCCCCABYTY (SEQ ID NO: 2540) |
| 210 | +TYTTRT + CT + GGTGTRGWRARYCCCCABYTY (SEQ ID NO: 2541) |
| 210 | +TYTTR + T + CTGGTGTRGWRARYCCCCABYTY (SEQ ID NO: 2542) |
| 210 | +GYT + TYTTRT + CTGGTGTRGWRARYCCCCABYTY (SEQ ID NO: 2543) |
| 210 | +GYTTYTTR + T + CTGGTGTRGWRARYCCCCABYTY (SEQ ID NO: 2544) |
| 210 | +GYT + TYTTR + TCTGGTGTRGWRARYCCCCABYTY (SEQ ID NO: 2545) |
| 210 | +T + GYTTYTTR + TCTGGTGTRGWRARYCCCCABYTY (SEQ ID NO: 2546) |
| 210 | +TGYT + TYTTR + TCTGGTGTRGWRARYCCCCABYTY (SEQ ID NO: 2547) |
| 210 | +T + GYT + TYTTRTCTGGTGTRGWRARYCCCCABYTY (SEQ ID NO: 2548) |
| 210 | YTTY + T + G + ATGYTTYTTRTCTGGTGTRGWRARYCCCCABYTY (SEQ ID NO: 2549) |
| 215 | AATGGRGGTTCYTTYTGATGYTTYTTRTCTGGTGTR (SEQ ID NO: 2550) |
| 215 | GRAATGGRGGTTCYTTYTGATGYTTYTTRTCTGGTGTR (SEQ ID NO: 2551) |
| 215 | AAGRAATGGRGGTTCYTTYTGATGYTTYTTRTCTGGTGTR (SEQ ID NO: 2552) |
| 215 | GRGGTTCYTTYTGATGYTTYTTRTCTGGTGTR (SEQ ID NO: 2553) |
| 215 | GGRGGTTCYTTYTGATGYTTYTTRTCTGGTGTR (SEQ ID NO: 2554) |
| 215 | ATGGRGGTTCYTTYTGATGYTTYTTRTCTGGTGTR (SEQ ID NO: 2555) |
| 215 | ATAHCCCATCCARAGRAATGGRGGTTCYTTYTGATGYTTYTTRTCTGGTGT (SEQ ID NO: 2556) |
| 215 | AATGGRGGTTCYTTYTGATGYTTYTTRTCTGGTGTR + N (SEQ ID NO: 2557) |
| 215 | GRAATGGRGGTTCYTTYTGATGYTTYTTRTCTGGTGTR + N (SEQ ID NO: 2558) |
| 215 | AAGRAATGGRGGTTCYTTYTGATGYTTYTTRTCTGGTGTR + N (SEQ ID NO: 2559) |
| 215 | GRGGTTCYTTYTGATGYTTYTTRTCTGGTGTR + N (SEQ ID NO: 2560) |
| 215 | GGRGGTTCYTTYTGATGYTTYTTRTCTGGTGTR + N (SEQ ID NO: 2561) |
| 215 | ATGGRGGTTCYTTYTGATGYTTYTTRTCTGGTGTR + N (SEQ ID NO: 2562) |
| 215 | ATAHCCCATCCARAGRAATGGRGGTTCYTTYTGATGYTTYTTRTCTGGTGT + N (SEQ ID NO: 2563) |

TABLE 5 -continued

| | | |
|---|---|---|
| 215 | +A + ATG + GRGGTTCYTTYTGATGYTTYTTRTCTGGTGTR | (SEQ ID NO: 2564) |
| 215 | +AAT + G + GRGGTTCYTTYTGATGYTTYTTRTCTGGTGTR | (SEQ ID NO: 2565) |
| 215 | +A + AT + GGRGGTTCYTTYTGATGYTTYTTRTCTGGTGTR | (SEQ ID NO: 2566) |
| 215 | +GR + AAT + GGRGGTTCYTTYTGATGYTTYTTRTCTGGTGTR | (SEQ ID NO: 2567) |
| 215 | +GRA + AT + GGRGGTTCYTTYTGATGYTTYTTRTCTGGTGTR | (SEQ ID NO: 2568) |
| 215 | +GR + A + ATGGRGGTTCYTTYTGATGYTTYTTRTCTGGTGTR | (SEQ ID NO: 2569) |
| 215 | A + A + GRA + ATGGRGGTTCYTTYTGATGYTTYTTRTCTGGTGTR | (SEQ ID NO: 2570) |
| 215 | A + AGR + A + ATGGRGGTTCYTTYTGATGYTTYTTRTCTGGTGTR | (SEQ ID NO: 2571) |
| 215 | +GRGGT + TCYT + TYTGATGYTTYTTRTCTGGTGTR | (SEQ ID NO: 2572) |
| 215 | +GRGGTT + CYT + TYTGATGYTTYTTRTCTGGTGTR | (SEQ ID NO: 2573) |
| 215 | +GRGGT + T + CYTTYTGATGYTTYTTRTCTGGTGTR | (SEQ ID NO: 2574) |
| 215 | +G + GRGGTT + CYTTYTGATGYTTYTTRTCTGGTGTR | (SEQ ID NO: 2575) |
| 215 | +GGRGGT + T + CYTTYTGATGYTTYTTRTCTGGTGTR | (SEQ ID NO: 2576) |
| 215 | +G + GRGGT + TCYTTYTGATGYTTYTTRTCTGGTGTR | (SEQ ID NO: 2577) |
| 215 | +AT + GGRGGT + TCYTTYTGATGYTTYTTRTCTGGTGTR | (SEQ ID NO: 2578) |
| 215 | +ATG + GRGGT + TCYTTYTGATGYTTYTTRTCTGGTGTR | (SEQ ID NO: 2579) |
| 215 | +AT + G + GRGGTTCYTTYTGATGYTTYTTRTCTGGTGTR | (SEQ ID NO: 2580) |
| 215 | A + A + GR + AATGGRGGTTCYTTYTGATGYTTYTTRTCTGGTGTR | (SEQ ID NO: 2581) |
| 219 | ATCCAAAGRAATGGRGGTTCYTTYTGATGYTTYT | (SEQ ID NO: 2582) |
| 219 | HCCCATCCAAAGRAATGGRGGTTCYTTYTGATGYTT | (SEQ ID NO: 2583) |
| 219 | CCATCCAAAGRAATGGRGGTTCYTTYTGATGYTTY | (SEQ ID NO: 2584) |
| 219 | CCCATCCAAAGRAATGGRGGTTCYTTYTGATGYTTYT | (SEQ ID NO: 2585) |
| 219 | ATAHCCCATCCAAAGRAATGGRGGTTCYTTYTGATGYTT | (SEQ ID NO: 2586) |
| 219 | AHCCCATCCAAAGRAATGGRGGTTCYTTYTGATGYTTY | (SEQ ID NO: 2587) |
| 219 | TAHCCCATCCAAAGRAATGGRGGTTCYTTYTGATGYTTYT | (SEQ ID NO: 2588) |
| 219 | CATAHCCCATCCAAAGRAATGGRGGTTCYTTYTGATGYTT | (SEQ ID NO: 2589) |
| 219 | ATAHCCCATCCAAAGRAATGGRGGTTCYTTYTGATGYTTY | (SEQ ID NO: 2590) |
| 219 | AGRAATGGRGGTTCYTTYTGATGYTTYT | (SEQ ID NO: 2591) |
| 219 | CCAAAGRAATGGRGGTTCYTTYTGATGYTT | (SEQ ID NO: 2592) |
| 219 | AAAGRAATGGRGGTTCYTTYTGATGYTTY | (SEQ ID NO: 2593) |
| 219 | CAAAGRAATGGRGGTTCYTTYTGATGYTTYT | (SEQ ID NO: 2594) |
| 219 | CATCCAAAGRAATGGRGGTTCYTTYTGATGYTT | (SEQ ID NO: 2595) |
| 219 | TCCAAAGRAATGGRGGTTCYTTYTGATGYTTY | (SEQ ID NO: 2596) |
| 219 | CCAAAGRAATGGRGGTTCYTTYTGATGYTTYT | (SEQ ID NO: 2597) |
| 219 | CCATCCAAAGRAATGGRGGTTCYTTYTGATGYTT | (SEQ ID NO: 2598) |
| 219 | ATCCAAAGRAATGGRGGTTCYTTYTGATGYTTY | (SEQ ID NO: 2599) |
| 219 | AGGATGGAGYTCATAHCCCATCCARAGRAATGGRGGTTCYTTYTGATGTTT | (SEQ ID NO: 2600) |
| 219 | ATCCAAAGRAATGGRGGTTCYTTYTGATGYTTYT + N | (SEQ ID NO: 2601) |
| 219 | HCCCATCCAAAGRAATGGRGGTTCYTTYTGATGYTT + N | (SEQ ID NO: 2602) |

TABLE 5 -continued

| | |
|---|---|
| 219 | CCATCCAAAGRAATGGRGGTTCYTTYTGATGYTTY + N (SEQ ID NO: 2603) |
| 219 | CCCATCCAAAGRAATGGRGGTTCYTTYTGATGYTTYT + N (SEQ ID NO: 2604) |
| 219 | ATAHCCCATCCAAAGRAATGGRGGTTCYTTYTGATGYTT + N (SEQ ID NO: 2605) |
| 219 | AHCCCATCCAAAGRAATGGRGGTTCYTTYTGATGYTTY + N (SEQ ID NO: 2606) |
| 219 | TAHCCCATCCAAAGRAATGGRGGTTCYTTYTGATGYTTYT + N (SEQ ID NO: 2607) |
| 219 | CATAHCCCATCCAAAGRAATGGRGGTTCYTTYTGATGYTT + N (SEQ ID NO: 2608) |
| 219 | ATAHCCCATCCAAAGRAATGGRGGTTCYTTYTGATGYTTY + N (SEQ ID NO: 2609) |
| 219 | AGRAATGGRGGTTCYTTYTGATGYTTYT + N (SEQ ID NO: 2610) |
| 219 | CCAAAGRAATGGRGGTTCYTTYTGATGYTT + N (SEQ ID NO: 2611) |
| 219 | AAAGRAATGGRGGTTCYTTYTGATGYTTY + N (SEQ ID NO: 2612) |
| 219 | CAAAGRAATGGRGGTTCYTTYTGATGYTTYT + N (SEQ ID NO: 2613) |
| 219 | CATCCAAAGRAATGGRGGTTCYTTYTGATGYTT + N (SEQ ID NO: 2614) |
| 219 | TCCAAAGRAATGGRGGTTCYTTYTGATGYTTY + N (SEQ ID NO: 2615) |
| 219 | CCAAAGRAATGGRGGTTCYTTYTGATGYTTYT + N (SEQ ID NO: 2616) |
| 219 | CCATCCAAAGRAATGGRGGTTCYTTYTGATGYTT + N (SEQ ID NO: 2617) |
| 219 | ATCCAAAGRAATGGRGGTTCYTTYTGATGYTTY + N (SEQ ID NO: 2618) |
| 219 | AGGATGGAGYTCATAHCCCATCCARAGRAATGGRGGTTCYTTYTGATGTTT + N (SEQ ID NO: 2619) |
| 219 | +AT + CCAA + AGRAATGGRGGTTCYTTYTGATGYTTYT (SEQ ID NO: 2620) |
| 219 | +HC + CCAT + CCAAAGRAATGGRGGTTCYTTYTGATGYTT (SEQ ID NO: 2621) |
| 219 | +CC + ATCC + AAAGRAATGGRGGTTCYTTYTGATGYTTY (SEQ ID NO: 2622) |
| 219 | +ATC + CAA + AGRAATGGRGGTTCYTTYTGATGYTTYT (SEQ ID NO: 2623) |
| 219 | +HCC + CAT + CCAAAGRAATGGRGGTTCYTTYTGATGYTT (SEQ ID NO: 2624) |
| 219 | +CCA + TCC + AAAGRAATGGRGGTTCYTTYTGATGYTTY (SEQ ID NO: 2625) |
| 219 | +AT + C + CAAAGRAATGGRGGTTCYTTYTGATGYTTYT (SEQ ID NO: 2626) |
| 219 | +HC + C + CATCCAAAGRAATGGRGGTTCYTTYTGATGYTT (SEQ ID NO: 2627) |
| 219 | +CC + A + TCCAAAGRAATGGRGGTTCYTTYTGATGYTTY (SEQ ID NO: 2628) |
| 219 | +CCC + ATC + CAAAGRAATGGRGGTTCYTTYTGATGYTTYT (SEQ ID NO: 2629) |
| 219 | +ATA + HCC + CATCCAAAGRAATGGRGGTTCYTTYTGATGYTT (SEQ ID NO: 2630) |
| 219 | +AHC + CCA + TCCAAAGRAATGGRGGTTCYTTYTGATGYTTY (SEQ ID NO: 2631) |
| 219 | +CCCAT + C + CAAAGRAATGGRGGTTCYTTYTGATGYTTYT (SEQ ID NO: 2632) |
| 219 | +ATAHC + C + CATCCAAAGRAATGGRGGTTCYTTYTGATGYTT (SEQ ID NO: 2633) |
| 219 | +AHCCC + A + TCCAAAGRAATGGRGGTTCYTTYTGATGYTTY (SEQ ID NO: 2634) |
| 219 | +CCC + AT + CCAAAGRAATGGRGGTTCYTTYTGATGYTTYT (SEQ ID NO: 2635) |
| 219 | +ATA + HC + CCATCCAAAGRAATGGRGGTTCYTTYTGATGYTT (SEQ ID NO: 2636) |
| 219 | +AHC + CC + ATCCAAAGRAATGGRGGTTCYTTYTGATGYTTY (SEQ ID NO: 2637) |
| 219 | +TA + HCCC + ATCCAAAGRAATGGRGGTTCYTTYTGATGYTTYT (SEQ ID NO: 2638) |

TABLE 5 -continued

| | | |
|---|---|---|
| 219 | +C + ATAHC + CCATCCAAAGRAATGGRGGTTCYTTYTGATGYTT (SEQ ID NO: 2639) | |
| 219 | A + T + AHCCC + ATCCAAAGRAATGGRGGTTCYTTYTGATGYTTY (SEQ ID NO: 2640) | |
| 219 | +CATA + HC + CCATCCAAAGRAATGGRGGTTCYTTYTGATGYTT (SEQ ID NO: 2641) | |
| 219 | A + TAHC + CC + ATCCAAAGRAATGGRGGTTCYTTYTGATGYTTY (SEQ ID NO: 2642) | |
| 219 | +AG + RAA + TGGRGGTTCYTTYTGATGYTTYT (SEQ ID NO: 2643) | |
| 219 | +CC + AAA + GRAATGGRGGTTCYTTYTGATGYTT (SEQ ID NO: 2644) | |
| 219 | +AA + AGR + AATGGRGGTTCYTTYTGATGYTTY (SEQ ID NO: 2645) | |
| 219 | +AGR + AA + TGGRGGTTCYTTYTGATGYTTYT (SEQ ID NO: 2646) | |
| 219 | +CCA + AA + GRAATGGRGGTTCYTTYTGATGYTT (SEQ ID NO: 2647) | |
| 219 | +AAA + GR + AATGGRGGTTCYTTYTGATGYTTY (SEQ ID NO: 2648) | |
| 219 | +AG + R + AATGGRGGTTCYTTYTGATGYTTYT (SEQ ID NO: 2649) | |
| 219 | +CC + A + AAGRAATGGRGGTTCYTTYTGATGYTT (SEQ ID NO: 2650) | |
| 219 | +AA + A + GRAATGGRGGTTCYTTYTGATGYTTY (SEQ ID NO: 2651) | |
| 219 | +CAA + AGR + AATGGRGGTTCYTTYTGATGYTTYT (SEQ ID NO: 2652) | |
| 219 | +CAT + CCA + AAGRAATGGRGGTTCYTTYTGATGYTT (SEQ ID NO: 2653) | |
| 219 | +TCC + AAA + GRAATGGRGGTTCYTTYTGATGYTTY (SEQ ID NO: 2654) | |
| 219 | +CAAAG + R + AATGGRGGTTCYTTYTGATGYTTYT (SEQ ID NO: 2655) | |
| 219 | +CATCC + A + AAGRAATGGRGGTTCYTTYTGATGYTT (SEQ ID NO: 2656) | |
| 219 | +TCCAA + A + GRAATGGRGGTTCYTTYTGATGYTTY (SEQ ID NO: 2657) | |
| 219 | +CAA + AG + RAATGGRGGTTCYTTYTGATGYTTYT (SEQ ID NO: 2658) | |
| 219 | +CAT + CC + AAAGRAATGGRGGTTCYTTYTGATGYTT (SEQ ID NO: 2659) | |
| 219 | +TCC + AA + AGRAATGGRGGTTCYTTYTGATGYTTY (SEQ ID NO: 2660) | |
| 219 | +C + CAAAG + RAATGGRGGTTCYTTYTGATGYTTYT (SEQ ID NO: 2661) | |
| 219 | +C + CATCC + AAAGRAATGGRGGTTCYTTYTGATGYTT (SEQ ID NO: 2662) | |
| 219 | +A + TCCAA + AGRAATGGRGGTTCYTTYTGATGYTTY (SEQ ID NO: 2663) | |
| 219 | +CCAA + AG + RAATGGRGGTTCYTTYTGATGYTTYT (SEQ ID NO: 2664) | |
| 219 | +CCAT + CC + AAAGRAATGGRGGTTCYTTYTGATGYTT (SEQ ID NO: 2665) | |
| 219 | +ATCC + AA + AGRAATGGRGGTTCYTTYTGATGYTTY (SEQ ID NO: 2666) | |
| 219 | +C + CAA + AGRAATGGRGGTTCYTTYTGATGYTTYT (SEQ ID NO: 2667) | |
| 219 | +C + CAT + CCAAAGRAATGGRGGTTCYTTYTGATGYTT (SEQ ID NO: 2668) | |
| 219 | +A + TCC + AAAGRAATGGRGGTTCYTTYTGATGYTTY (SEQ ID NO: 2669) | |
| 219 | TA + H + CCC + ATCCAAAGRAATGGRGGTTCYTTYTGATGYTTYT (SEQ ID NO: 2670) | |
| 219 | +C + ATA + HCCCATCCAAAGRAATGGRGGTTCYTTYTGATGYTT (SEQ ID NO: 2671) | |
| 219 | A + T + AHC + CCATCCAAAGRAATGGRGGTTCYTTYTGATGYTTY (SEQ ID NO: 2672) | |
| 225 | CAGGATGGAGYTCATAHCCCATCCAAAGRAATGGR (SEQ ID NO: 2673) | |
| 225 | TRTCAGGATGGAGYTCATAHCCCATCCAAAGRAATGGR (SEQ ID NO: 2674) | |

TABLE 5 -continued

| | |
|---|---|
| 225 | YTTRTCAGGATGGAGYTCATAHCCCATCCAAAGRAATGGR (SEQ ID NO: 2675) |
| 225 | GAGYTCATAHCCCATCCAAAGRAATGGR (SEQ ID NO: 2676) |
| 225 | GGAGYTCATAHCCCATCCAAAGRAATGGR (SEQ ID NO: 2677) |
| 225 | TGGAGYTCATAHCCCATCCAAAGRAATGGR (SEQ ID NO: 2678) |
| 225 | YTGBACTGTCCAYYTRTCAGGATGGAGYTCATAHCCCATCCARAGGAATGG (SEQ ID NO: 2679) |
| 225 | CAGGATGGAGYTCATAHCCCATCCAAAGRAATGGR + N (SEQ ID NO: 2680) |
| 225 | TRTCAGGATGGAGYTCATAHCCCATCCAAAGRAATGGR + N (SEQ ID NO: 2681) |
| 225 | YTTRTCAGGATGGAGYTCATAHCCCATCCAAAGRAATGGR + N (SEQ ID NO: 2682) |
| 225 | GAGYTCATAHCCCATCCAAAGRAATGGR + N (SEQ ID NO: 2683) |
| 225 | GGAGYTCATAHCCCATCCAAAGRAATGGR + N (SEQ ID NO: 2684) |
| 225 | TGGAGYTCATAHCCCATCCAAAGRAATGGR + N (SEQ ID NO: 2685) |
| 225 | YTGBACTGTCCAYYTRTCAGGATGGAGYTCATAHCCCATCCARAGGAATGG + N (SEQ ID NO: 2686) |
| 225 | +CAGGA + TG + GAGYTCATAHCCCATCCAAAGRAATGGR (SEQ ID NO: 2687) |
| 225 | +CAGGAT + G + GAGYTCATAHCCCATCCAAAGRAATGGR (SEQ ID NO: 2688) |
| 225 | +CAGGA + T + GGAGYTCATAHCCCATCCAAAGRAATGGR (SEQ ID NO: 2689) |
| 225 | +TRT + CAGGAT + GGAGYTCATAHCCCATCCAAAGRAATGGR (SEQ ID NO: 2690) |
| 225 | +TRTCAGGA + GGAGYTCATAHCCCATCCAAAGRAATGGR (SEQ ID NO: 2691) |
| 225 | +TRT + CAGGA + TGGAGYTCATAHCCCATCCAAAGRAATGGR (SEQ ID NO: 2692) |
| 225 | Y + T + TRTCAGGA + TGGAGYTCATAHCCCATCCAAAGRAATGGR (SEQ ID NO: 2693) |
| 225 | Y + TTRT + CAGGA + TGGAGYTCATAHCCCATCCAAAGRAATGGR (SEQ ID NO: 2694) |
| 225 | +GA + GY + TCATAHCCCATCCAAAGRAATGGR (SEQ ID NO: 2695) |
| 225 | +GAG + Y + TCATAHCCCATCCAAAGRAATGGR (SEQ ID NO: 2696) |
| 225 | +GA + G + YTCATAHCCCATCCAAAGRAATGGR (SEQ ID NO: 2697) |
| 225 | +G + GAG + YTCATAHCCCATCCAAAGRAATGGR (SEQ ID NO: 2698) |
| 225 | +GGA + G + YTCATAHCCCATCCAAAGRAATGGR (SEQ ID NO: 2699) |
| 225 | +G + GA + GYTCATAHCCCATCCAAAGRAATGGR (SEQ ID NO: 2700) |
| 225 | +T + GGA + GYTCATAHCCCATCCAAAGRAATGGR (SEQ ID NO: 2701) |
| 225 | +TG + GA + GYTCATAHCCCATCCAAAGRAATGGR (SEQ ID NO: 2702) |
| 225 | +T + G + GAGYTCATAHCCCATCCAAAGRAATGGR (SEQ ID NO: 2703) |
| 225 | Y + T + TRT + CAGGATGGAGYTCATAHCCCATCCAAAGRAATGGR (SEQ ID NO: 2704) |
| 227 | TTRTCAGGATGGAGYTCATAHCCCATCCAAAGRA (SEQ ID NO: 2705) |
| 227 | YTTRTCAGGATGGAGYTCATAHCCCATCCAAAGR (SEQ ID NO: 2706) |
| 227 | YTTRTCAGGATGGAGYTCATAHCCCATCCAAAGRA (SEQ ID NO: 2707) |
| 227 | AYTTRTCAGGATGGAGYTCATAHCCCATCCAAAGR (SEQ ID NO: 2708) |
| 227 | GTCCAYTTRTCAGGATGGAGYTCATAHCCCATCCAAAGRA (SEQ ID NO: 2709) |
| 227 | TGTCCAYTTRTCAGGATGGAGYTCATAHCCCATCCAAAGR (SEQ ID NO: 2710) |
| 227 | CAGGATGGAGYTCATAHCCCATCCAAAGRA (SEQ ID NO: 2711) |
| 227 | TCAGGATGGAGYTCATAHCCCATCCAAAGR (SEQ ID NO: 2712) |

TABLE 5 -continued

| 227 | TCAGGATGGAGYTCATAHCCCATCCAAAGRA (SEQ ID NO: 2713) |
| --- | --- |
| 227 | RTCAGGATGGAGYTCATAHCCCATCCAAAGR (SEQ ID NO: 2714) |
| 227 | TRTCAGGATGGAGYTCATAHCCCATCCAAAGRA (SEQ ID NO: 2715) |
| 227 | TRTCAGGATGGAGYTCATAHCCCATCCAAAGR (SEQ ID NO: 2716) |
| 227 | TATAGGYTGBACTGTCCAYYTRTCAGGATGGAGYTCATAHCCCATCCAAAG (SEQ ID NO: 2717) |
| 227 | TTRTCAGGATGGAGYTCATAHCCCATCCAAAGRA + N (SEQ ID NO: 2718) |
| 227 | YTTRTCAGGATGGAGYTCATAHCCCATCCAAAGR + N (SEQ ID NO: 2719) |
| 227 | YTTRTCAGGATGGAGYTCATAHCCCATCCAAAGRA + N (SEQ ID NO: 2720) |
| 227 | AYTTRTCAGGATGGAGYTCATAHCCCATCCAAAGR + N (SEQ ID NO: 2721) |
| 227 | GTCCAYTTRTCAGGATGGAGYTCATAHCCCATCCAAAGRA + N (SEQ ID NO: 2722) |
| 227 | TGTCCAYTTRTCAGGATGGAGYTCATAHCCCATCCAAAGR + N (SEQ ID NO: 2723) |
| 227 | CAGGATGGAGYTCATAHCCCATCCAAAGRA + N (SEQ ID NO: 2724) |
| 227 | TCAGGATGGAGYTCATAHCCCATCCAAAGR + N (SEQ ID NO: 2725) |
| 227 | TCAGGATGGAGYTCATAHCCCATCCAAAGRA + N (SEQ ID NO: 2726) |
| 227 | RTCAGGATGGAGYTCATAHCCCATCCAAAGR + N (SEQ ID NO: 2727) |
| 227 | TRTCAGGATGGAGYTCATAHCCCATCCAAAGRA + N (SEQ ID NO: 2728) |
| 227 | TRTCAGGATGGAGYTCATAHCCCATCCAAAGR + N (SEQ ID NO:2729) |
| 227 | TATAGGYTGBACTGTCCAYYTRTCAGGATGGAGYTCATAHCCCATCCAAAG + N (SEQ ID NO: 2730) |
| 227 | +T + TRT + CAGGATGGAGYTCATAHCCCATCCAAAGRA (SEQ ID NO: 2731) |
| 227 | +YT + TR + TCAGGATGGAGYTCATAHCCCATCCAAAGR (SEQ ID NO: 2732) |
| 227 | +TTR + T + CAGGATGGAGYTCATAHCCCATCCAAAGRA (SEQ ID NO: 2733) |
| 227 | +YTT + R + TCAGGATGGAGYTCATAHCCCATCCAAAGR (SEQ ID NO: 2734) |
| 227 | +T + TR + TCAGGATGGAGYTCATAHCCCATCCAAAGRA (SEQ ID NO: 2735) |
| 227 | +YT + T + RTCAGGATGGAGYTCATAHCCCATCCAAAGR (SEQ ID NO: 2736) |
| 227 | +Y + TTR + TCAGGATGGAGYTCATAHCCCATCCAAAGRA (SEQ ID NO: 2737) |
| 227 | +A + YTT + RTCAGGATGGAGYTCATAHCCCATCCAAAGR (SEQ ID NO: 2738) |
| 227 | +YT + TR + TCAGGATGGAGYTCATAHCCCATCCAAAGRA (SEQ ID NO: 2739) |
| 227 | +AYT + T + RTCAGGATGGAGYTCATAHCCCATCCAAAGR (SEQ ID NO: 2740) |
| 227 | +Y + T + TRTCAGGATGGAGYTCATAHCCCATCCAAAGRA (SEQ ID NO: 2741) |
| 227 | +A + YT + TRTCAGGATGGAGYTCATAHCCCATCCAAAGR (SEQ ID NO: 2742) |
| 227 | +GTCCA + YT + TRTCAGGATGGAGYTCATAHCCCATCCAAAGRA (SEQ ID NO: 2743) |
| 227 | TGTC + C + AYT + TRTCAGGATGGAGYTCATAHCCCATCCAAAGR (SEQ ID NO: 2744) |
| 227 | +GTCCAY + T + TRTCAGGATGGAGYTCATAHCCCATCCAAAGRA (SEQ ID NO: 2745) |
| 227 | TGTC + CA + YT + TRTCAGGATGGAGYTCATAHCCCATCCAAAGR (SEQ ID NO: 2746) |
| 227 | +C + AGG + ATGGAGYTCATAHCCCATCCAAAGRA (SEQ ID NO: 2747) |
| 227 | +T + CAG + GATGGAGYTCATAHCCCATCCAAAGR (SEQ ID NO: 2748) |
| 227 | +CA + GG + ATGGAGYTCATAHCCCATCCAAAGRA (SEQ ID NO: 2749) |

TABLE 5-continued

| | | |
|---|---|---|
| 227 | +TCA + G + GATGGAGYTCATAHCCCATCCAAAGR (SEQ ID NO: 2750) | |
| 227 | +C + A + GGATGGAGYTCATAHCCCATCCAAAGRA (SEQ ID NO: 2751) | |
| 227 | +T + CA + GGATGGAGYTCATAHCCCATCCAAAGR (SEQ ID NO: 2752) | |
| 227 | +T + CA + GGATGGAGYTCATAHCCCATCCAAAGRA (SEQ ID NO: 2753) | |
| 227 | +R + TCA + GGATGGAGYTCATAHCCCATCCAAAGR (SEQ ID NO: 2754) | |
| 227 | +TC + A + GGATGGAGYTCATAHCCCATCCAAAGRA (SEQ ID NO: 2755) | |
| 227 | +RT + CA + GGATGGAGYTCATAHCCCATCCAAAGR (SEQ ID NO: 2756) | |
| 227 | +T + C + AGGATGGAGYTCATAHCCCATCCAAAGRA (SEQ ID NO: 2757) | |
| 227 | +R + T + CAGGATGGAGYTCATAHCCCATCCAAAGR (SEQ ID NO: 2758) | |
| 227 | +TR + TC + AGGATGGAGYTCATAHCCCATCCAAAGRA (SEQ ID NO: 2759) | |
| 227 | +T + RT + CAGGATGGAGYTCATAHCCCATCCAAAGR (SEQ ID NO: 2760) | |
| 227 | +TRT + C AGGATGGAGYTCATAHCCCATCCAAAGRA (SEQ ID NO: 2761) | |
| 227 | +TR + T + CAGGATGGAGYTCATAHCCCATCCAAAGR (SEQ ID NO: 2762) | |
| 227 | +TR + T CAGGATGGAGYCATAHCCCATCCAAAGRA (SEQ ID NO: 2763) | |
| 227 | +T + R + TCAGGATGGAGYTCATAHCCCATCCAAAGR (SEQ ID NO: 2764) | |
| 227 | +GTCCA + Y + TTRTCAGGATGGAGYTCATAHCCCATCCAAAGRA (SEQ ID NO: 2765) | |
| 227 | TGTC + C + A + YTTRTCAGGATGGAGYTCATAHCCCATCCAAAGR (SEQ ID NO: 2766) | |
| 230 | YTGKACTGTCCAYTTRTCAGGATGGAGYTCATAHCCCA (SEQ ID NO: 2767) | |
| 230 | GYTGKACTGTCCAYTTRTCAGGATGGAGYTCATAHCCCA (SEQ ID NO: 2768) | |
| 230 | GGYTGKACTGTCCAYTTRTCAGGATGGAGYTCATAHCCCA (SEQ ID NO: 2769) | |
| 230 | ACTGTCCAYTTRTCAGGATGGAGYTCATAHCCCA (SEQ ID NO: 2770) | |
| 230 | KACTGTCCAYTTRTCAGGATGGAGYTCATAHCCCA (SEQ ID NO: 2771) | |
| 230 | TGKACTGTCCAYTTRTCAGGATGGAGYTCATAHCCCA (SEQ ID NO: 2772) | |
| 230 | GGYARYWBTATAGGYTGBACTGTCCAYYTRTCAGGATGGAGYTCATAACC (SEQ ID NO: 2773) | |
| 230 | YTGKACTGTCCAYTTRTCAGGATGGAGYTCATAHCCCA + N (SEQ ID NO: 2774) | |
| 230 | GYTGKACTGTCCAYTTRTCAGGATGGAGYTCATAHCCCA + N (SEQ ID NO: 2775) | |
| 230 | GGYTGKACTGTCCAYTTRTCAGGATGGAGYTCATAHCCCA + N (SEQ ID NO: 2776) | |
| 230 | ACTGTCCAYTTRTCAGGATGGAGYTCATAHCCCA + N (SEQ ID NO: 2777) | |
| 230 | KACTGTCCAYTTRTCAGGATGGAGYTCATAHCCCA + N (SEQ ID NO: 2778) | |
| 230 | TGKACTGTCCAYTTRTCAGGATGGAGYTCATAHCCCA + N (SEQ ID NO: 2779) | |
| 230 | GGYARYWBTATAGGYTGBACTGTCCAYYTRTCAGGATGGAGYTCATAACC + N (SEQ ID NO: 2780) | |
| 230 | +Y + TGK + ACTGTCCAYTTRTCAGGATGGAGYTCATAHCCCA (SEQ ID NO: 2781) | |
| 230 | +YTG + K + ACTGTCCAYTTRTCAGGATGGAGYTCATAHCCCA (SEQ ID NO: 2782) | |
| 230 | +Y + TG + KACTGTCCAYTTRTCAGGATGGAGYTCATAHCCCA (SEQ ID NO: 2783) | |
| 230 | +G + YTG + KACTGTCCAYTTRTCAGGATGGAGYTCATAHCCCA (SEQ ID NO: 2784) | |

TABLE 5 -continued

| | |
|---|---|
| 230 | +GY + TG + KACTGTCCAYTTRTCAGGATGGAGYTCATAHCCCA (SEQ ID NO: 2785) |
| 230 | +G + Y + TGKACTGTCCAYTTRTCAGGATGGAGYTCATAHCCCA (SEQ ID NO: 2786) |
| 230 | G + G + YTG + KACTGTCCAYTTRTCAGGATGGAGYTCATAHCCCA (SEQ ID NO: 2787) |
| 230 | GG + Y + TG + KACTGTCCAYTTRTCAGGATGGAGYTCATAHCCCA (SEQ ID NO: 2788) |
| 230 | +AC + TGT + CCAYTTRTCAGGATGGAGYTCATAHCCCA (SEQ ID NO: 2789) |
| 230 | +ACT + GT + CCAYTTRTCAGGATGGAGYTCATAHCCCA (SEQ ID NO: 2790) |
| 230 | +AC + T + GTCCAYTTRTCAGGATGGAGYTCATAHCCCA (SEQ ID NO: 2791) |
| 230 | +K + ACT + GTCCAYTTRTCAGGATGGAGYTCATAHCCCA (SEQ ID NO: 2792) |
| 230 | +KAC + T + GTCCAYTTRTCAGGATGGAGYTCATAHCCCA (SEQ ID NO: 2793) |
| 230 | +K + AC + TGTCCAYTTRTCAGGATGGAGYTCATAHCCCA (SEQ ID NO: 2794) |
| 230 | +TG + KAC + TGTCCAYTTRTCAGGATGGAGYTCATAHCCCA (SEQ ID NO: 2795) |
| 230 | +TGK + AC + TGTCCAYTTRTCAGGATGGAGYTCATAHCCCA (SEQ ID NO: 2796) |
| 230 | +TG + K + ACTGTCCAYTTRTCAGGATGGAGYTCATAHCCCA (SEQ ID NO: 2797) |
| 230 | +G + G + YTGKACTGTCCAYTTRTCAGGATGGAGYTCATAHCCCA (SEQ ID NO: 2798) |
| 238 | NTCYTTDTCTGGYARYWBTATAGGYTGKACTGTCCAY (SEQ ID NO: 2799) |
| 238 | TNTCYTTDTCTGGYARYWBTATAGGYTGKACTGTCCAY (SEQ ID NO: 2800) |
| 238 | GCTNTCYTTDTCTGGYARYWBTATAGGYTGKACTGTCCAY (SEQ ID NO: 2801) |
| 238 | TDTCTGGYARYWBTATAGGYTGKACTGTCCAY (SEQ ID NO: 2802) |
| 238 | CYTTDTCTGGYARYWBTATAGGYTGKACTGTCCAY (SEQ ID NO: 2803) |
| 238 | TCYTTDTCTGGYARYWBTATAGGYTGKACTGTCCAY (SEQ ID NO: 2804) |
| 238 | ATTGACAGTCCAGCTDTCYTTKTCTGGYARYWBTATAGGYTGBACTGTCCA (SEQ ID NO: 2805) |
| 238 | NTCYTTDTCTGGYARYWBTATAGGYTGKACTGTCCAY + N (SEQ ID NO: 2806) |
| 238 | TNTCYTTDTCTGGYARYWBTATAGGYTGKACTGTCCAY + N (SEQ ID NO: 2807) |
| 238 | GCTNTCYTTDTCTGGYARYWBTATAGGYTGKACTGTCCAY + N (SEQ ID NO: 2808) |
| 238 | TDTCTGGYARYWBTATAGGYTGKACTGTCCAY + N (SEQ ID NO: 2809) |
| 238 | CYTTDTCTGGYARYWBTATAGGYTGKACTGTCCAY + N (SEQ ID NO: 2810) |
| 238 | TCYTTDTCTGGYARYWBTATAGGYTGKACTGTCCAY + N (SEQ ID NO: 2811) |
| 238 | ATTGACAGTCCAGCTDTCYTTKTCTGGYARYWBTATAGGYTGBACTGTCCA + N (SEQ ID NO: 2812) |
| 238 | +N + TCYT + TDTCTGGYARYWBTATAGGYTGKACTGTCCAY (SEQ ID NO: 2813) |
| 238 | +NT + CYT + TDTCTGGYARYWBTATAGGYTGKACTGTCCAY (SEQ ID NO: 2814) |
| 238 | +N + T + CYTTDTCTGGYARYWBTATAGGYTGKACTGTCCAY (SEQ ID NO: 2815) |
| 238 | +T + NT + CYTTDTCTGGYARYWBTATAGGYTGKACTGTCCAY (SEQ ID NO: 2816) |

TABLE 5 -continued

| | |
|---|---|
| 238 | +TN + T + CYTTDTCTGGYARYWBTATAGGYTGKACTGTCCAY (SEQ ID NO: 2817) |
| 238 | +T + N + TCYTTDTCTGGYARYWBTATAGGYTGKACTGTCCAY (SEQ ID NO: 2818) |
| 238 | G + C + TN + TCYTTDTCTGGYARYWBTATAGGYTGKACTGTCCAY (SEQ ID NO: 2819) |
| 238 | G + CT + N + TCYTTDTCTGGYARYWBTATAGGYTGKACTGTCCAY (SEQ ID NO: 2820) |
| 238 | +TD + TCTGGYA + RYWBTATAGGYTGKACTGTCCAY (SEQ ID NO: 2821) |
| 238 | +TDT + CTGGYA + RYWBTATAGGYTGKACTGTCCAY (SEQ ID NO: 2822) |
| 238 | +TD + T + CTGGYARYWBTATAGGYTGKACTGTCCAY (SEQ ID NO: 2823) |
| 238 | +CYT + TDT + CTGGYARYWBTATAGGYTGKACTGTCCAY (SEQ ID NO: 2824) |
| 238 | +CYTTD + T + CTGGYARYWBTATAGGYTGKACTGTCCAY (SEQ ID NO: 2825) |
| 238 | +CYT + TD + TCTGGYARYWBTATAGGYTGKACTGTCCAY (SEQ ID NO: 2826) |
| 238 | +T + CYTTD + TCTGGYARYWBTATAGGYTGKACTGTCCAY (SEQ ID NO: 2827) |
| 238 | +TCYT + TD + TCTGGYARYWBTATAGGYTGKACTGTCCAY (SEQ ID NO: 2828) |
| 238 | +T + CYT + TDTCTGGYARYWBTATAGGYTGKACTGTCCAY (SEQ ID NO: 2829) |
| 238 | G + C + T + NTCYTTDTCTGGYARYWBTATAGGYTGKACTGTCCAY (SEQ ID NO: 2830) |
| 318 | TAYYTCWGCTAYYAADTCTTTTGWTGGRTCATA (SEQ ID NO: 2831) |
| 318 | YTTYTGTAYYTCWGCTAYYAADTCTTTTGWTGGRTCATA (SEQ ID NO: 2832) |
| 318 | GYTTYTGTAYYTCWGCTAYYAADTCTTTTGWTGGRTCATA (SEQ ID NO: 2833) |
| 318 | YCHWBYCCYTGYTTYTGTABTTCWGCTAYYAADTCTTTTGWTGGRTCATAAT (SEQ ID NO: 2834) |
| 318 | TAYYTCWGCTAYYAADTCTTTTGWTGGRTCATA + N (SEQ ID NO: 2835) |
| 318 | YTTYTGTAYYTCWGCTAYYAADTCTTTTGWTGGRTCATA + N (SEQ ID NO: 2836) |
| 318 | GYTTYTGTAYYTCWGCTAYYAADTCTTTTGWTGGRTCATA + N (SEQ ID NO: 2837) |
| 318 | YCHWBYCCYTGYTTYTGTABTTCWGCTAYYAADTCTTTTGWTGGRTCATAAT + N (SEQ ID NO: 2838) |
| 318 | +TAYYTCWGCTAYYAADTCTTTTGWTGGRTCATA (SEQ ID NO: 2839) |
| 318 | +YTTYTG + TAYYTCWGCTAYYAADTCTTTTGWTGGRTCATA (SEQ ID NO: 2840) |
| 318 | +YTTYTGTAYYTCWGCTAYYAADTCTTTTGWTGGRTCATA (SEQ ID NO: 2841) |
| 318 | G + YTTYTG + TAYYTCWGCTAYYAADTCTTTTGWTGGRTCATA (SEQ ID NO: 2842) |
| 318 | GYTTYTG + TAYYTCWGCTAYYAADTCTTTTGWTGGRTCATA (SEQ ID NO: 2843) |
| 318 | +G + YTTYTG + TAYYTCWGCTAYYAADTCTTTTGWTGGRTCATA (SEQ ID NO: 2844) |

Table 6 depicts amino acid substitutions in HIV-1 reverse transcriptase protein.

TABLE 6

| Codon | Single Letter Amino Acid Code | Amino Acid |
|---|---|---|
| 40 | F | Phenylalanine |
| 41 | L | Leucine |
| 44 | D | Aspartic acid |
| 44 | A | Alanine |
| 62 | V | Valine |
| 65 | R | Arginine |
| 65 | N | Asparagine |
| 67 | N | Asparagine |
| 67 | G | Glycine |
| 67 | E | Glutamic acid |
| 69 | ins | INSERTION |
| 69 | D | Aspartic acid |
| 69 | del | DELETION |
| 70 | E | Glutamic acid |
| 70 | G | Glycine |
| 70 | Q | Glutamine |
| 74 | V | Valine |
| 74 | I | Isoleucine |
| 75 | M | Methionine |
| 75 | T | Threonine |
| 75 | A | Alanine |
| 75 | S | Serine |
| 75 | I | Isoleucine |
| 77 | L | Leucine |
| 90 | I | Isoleucine |
| 98 | G | Glycine |
| 100 | I | Isoleucine |
| 101 | P | Proline |
| 101 | E | Glutamic acid |
| 101 | H | Histidine |
| 103 | N | Asparagine |
| 103 | S | Serine |
| 106 | A | Alanine |
| 106 | M | Methionine |
| 108 | I | Isoleucine |
| 115 | F | Phenylalanine |
| 116 | Y | Tyrosine |
| 118 | I | Isoleucine |
| 138 | K | Lysine |
| 138 | A | Alanine |
| 138 | G | Glycine |
| 138 | Q | Glutamine |
| 151 | M | Methionine |
| 179 | D | Aspartic acid |
| 179 | E | Glutamic acid |
| 179 | F | Phenylalanine |

TABLE 6-continued

| Codon | Single Letter Amino Acid Code | Amino Acid |
|---|---|---|
| 179 | T | Threonine |
| 179 | K | Lysine |
| 181 | C | Cysteine |
| 181 | I | Isoleucine |
| 181 | V | Valine |
| 184 | V | Valine |
| 184 | I | Isoleucine |
| 188 | L | Leucine |
| 188 | C | Cysteine |
| 188 | H | Histidine |
| 190 | A | Alanine |
| 190 | S | Serine |
| 190 | E | Glutamic acid |
| 190 | Q | Glutamine |
| 210 | W | Tryptophan |
| 215 | Y | Tyrosine |
| 215 | F | Phenylalanine |
| 215 | S | Serine |
| 215 | C | Cysteine |
| 215 | D | Aspartic acid |
| 215 | E | Glutamic acid |
| 215 | I | Isoleucine |
| 215 | V | Valine |
| 219 | Q | Glutamine |
| 219 | E | Glutamic acid |
| 219 | N | Asparagine |
| 219 | R | Arginine |
| 225 | H | Histidine |
| 227 | L | Leucine |
| 227 | C | Cysteine |
| 230 | L | Leucine |
| 238 | T | Threonine |
| 318 | F | Phenylalanine |

Table 7 depicts wild-type and mutant probes for the HIV-1 reverse transcriptase protein. A "+" symbol preceding a nucleotide denotes that the nucleotide is an LNA.

Lengthy table referenced here

US10100349-20181016-T00001

Please refer to the end of the specification for access instructions.

Table 8 depicts forward and reverse primers for the HIV-1 protease gene. A "+" symbol preceding a nucleotide denotes that the nucleotide is an LNA.

TABLE 8

| Codon | Forward Primer (5' to 3') |
|---|---|
| 10 | NHHRTATCCYTYRRCYTCCCTCARATCACTCTTTGGCARCGACCC (SEQ ID NO: 9976) |
| 10 | NHHRTATCCYTYRRCYTCCCTCARATCACTCTTTGGCARCGACCC + N (SEQ ID NO: 9977) |
| 11 | RTATCCYTYRRCYTCCCTCARATCACTCTTTGGCARCGACCCCTC (SEQ ID NO: 9978) |
| 11 | RTATCCYTYRRCYTCCCTCARATCACTCTTTGGCARCGACCCCTC + N (SEQ ID NO: 9979) |
| 20 | CTTTGGCARCGACCMNTHGTYDCARTAARRRTAGRRGGVCAACTA (SEQ ID NO: 9980) |
| 20 | CTTTGGCARCGACCMNTHGTYDCARTAARRRTAGRRGGVCAACTA + N (SEQ ID NO: 9981) |
| 23 | CGACCMNTHGTYDCARTAARRRTAGRRGGVCARHYRADRGAAGCT (SEQ ID NO: 9982) |
| 23 | CGACCMNTHGTYDCARTAARRRTAGRRGGVCARHYRADRGAAGCT + N (SEQ ID NO: 9983) |
| 24 | CCMNTHGTYDCARTAARRRTAGRRGGVCARHYRADRGARGCTCTA (SEQ ID NO: 9984) |

TABLE 8-continued

| Codon | |
|---|---|
| 24 | CCMNTHGTYDCARTAARRRTAGRRGGVCARHYRADRGARGCTCTA + N (SEQ ID NO: 9985) |
| 30 | RTAGRRGGVCARHYRADRGARGCYCTMTTAGAYACAGGAGCAGAT (SEQ ID NO: 9986) |
| 30 | RTAGRRGGVCARHYRADRGARGCYCTMTTAGAYACAGGAGCAGAT + N (SEQ ID NO: 9987) |
| 32 | GGVCARHYRADRGARGCYCTMTTAGAYACAGGAGCAGATGATACA (SEQ ID NO: 9988) |
| 32 | GGVCARHYRADRGARGCYCTMTTAGAYACAGGAGCAGATGATACA + N (SEQ ID NO: 9989) |
| 33 | CARHYRADRGARGCYCTMTTAGAYACAGGAGCAGATGATACAGTA (SEQ ID NO: 9990) |
| 33 | CARHYRADRGARGCYCTMTTAGAYACAGGAGCAGATGATACAGTA + N (SEQ ID NO: 9991) |
| 43 | GCAGATGATACAGTATTAGAAGAHATRRRKTTRCCAGGRAAATGG (SEQ ID NO: 9992) |
| 43 | GCAGATGATACAGTATTAGAAGAHATRRRKTTRCCAGGRAAATGG + N (SEQ ID NO: 9993) |
| 46 | ACAGTATTAGAAGAHATRRRKTTRCCAGGRARATGGAARCCAAAA (SEQ ID NO: 9994) |
| 46 | ACAGTATTAGAAGAHATRRRKTTRCCAGGRARATGGAARCCAAAA + N (SEQ ID NO: 9995) |
| 47 | AGAAGAHATRRRWT + TRCCA + G + GRARATGGAAACCAARAATG (SEQ ID NO: 9996) |
| 47 | AGAAGAHATRRRWT + TRCCAG + GRARA + TGGAAACCAARAATG (SEQ ID NO: 9997) |
| 47 | AGAAGAHATRRRWT + TRCCA + GGRARA + TGGAAACCAARAATG (SEQ ID NO: 9998) |
| 47 | +G + GRARA + TGGAAACCAARAATG (SEQ ID NO: 9999) |
| 47 | +GGRARA + T + GGAAACCAARAATG (SEQ ID NO: 10000) |
| 47 | +G + GRARAT + GGAAACCAARAATG (SEQ ID NO: 10001) |
| 47 | AGAAGAHATRRRWTTRCCAGGRARATGGAAACCAARAATG (SEQ ID NO: 10002) |
| 47 | GGRARATGGAAACCAARAATG (SEQ ID NO: 10003) |
| 47 | GTATTAGAAGAHATRRRKTTRCCAGGRARATGGAARCCAAAAATG (SEQ ID NO: 10004) |
| 47 | AGAAGAHATRRRWTTRCCAGGRARATGGAAACCAARAATG + N (SEQ ID NO: 10005) |
| 47 | GGRARATGGAAACCAARAATG + N (SEQ ID NO: 10006) |
| 47 | GTATTAGAAGAHATRRRKTTRCCAGGRARATGGAARCCAAAAATG + N (SEQ ID NO: 10007) |
| 48 | TTAGAAGAHATRRRKTTRCCAGGRARATGGAARCCAAAAATGATA (SEQ ID NO: 10008) |
| 48 | TTAGAAGAHATRRRKTTRCCAGGRARATGGAARCCAAAAATGATA + N (SEQ ID NO: 10009) |
| 50 | RRRWT + TRCCA + G + GRARATGGAAACCAARAATGATAGGRGGA (SEQ ID NO: 10010) |
| 50 | RRRWT + TRCCAG + GRARA + TGGAAACCAARAATGATAGGRGGA (SEQ ID NO: 10011) |
| 50 | RRRWT + TRCCA + GGRARA + TGGAAACCAARAATGATAGGRGGA (SEQ ID NO: 10012) |
| 50 | +G + GRARA + TGGAAACCAARAATGATAGGRGGA (SEQ ID NO: 10013) |
| 50 | +GGRARA + T + GGAAACCAARAATGATAGGRGGA (SEQ ID NO: 10014) |
| 50 | +G + GRARAT + GGAAACCAARAATGATAGGRGGA (SEQ ID NO: 10015) |
| 50 | +GRARA + T + GGAAACCAARAATGATAGGRGGA (SEQ ID NO: 10016) |
| 50 | +GRARAT + G + GAAACCAARAATGATAGGRGGA (SEQ ID NO: 10017) |
| 50 | +GRARA + TG + GAAACCAARAATGATAGGRGGA (SEQ ID NO: 10018) |
| 50 | +T + G + GAAACCAARAATGATAGGRGGA (SEQ ID NO: 10019) |
| 50 | +TG + G + AAACCAARAATGATAGGRGGA (SEQ ID NO: 10020) |
| 50 | +T + GG + AAACCAARAATGATAGGRGGA (SEQ ID NO: 10021) |
| 50 | +G + G + AAACCAARAATGATAGGRGGA (SEQ ID NO: 10022) |
| 50 | +GG + AAA + CCAARAATGATAGGRGGA (SEQ ID NO: 10023) |

TABLE 8-continued

| Codon | |
|---|---|
| 50 | +G + GAAA + CCAARAATGATAGGRGGA (SEQ ID NO: 10024) |
| 50 | +G + AAA + CCAARAATGATAGGRGGA (SEQ ID NO: 10025) |
| 50 | +GAAA + C + CAARAATGATAGGRGGA (SEQ ID NO: 10026) |
| 50 | +G + AAAC + CAARAATGATAGGRGGA (SEQ ID NO: 10027) |
| 50 | RRRWTTRCCAGGRARATGGAAACCAARAATGATAGGRGGA (SEQ ID NO: 10028) |
| 50 | GGRARATGGAAACCAARAATGATAGGRGGA (SEQ ID NO: 10029) |
| 50 | GRARATGGAAACCAARAATGATAGGRGGA (SEQ ID NO: 10030) |
| 50 | TGGAAACCAARAATGATAGGRGGA (SEQ ID NO: 10031) |
| 50 | GGAAACCAARAATGATAGGRGGA (SEQ ID NO: 10032) |
| 50 | GAAACCAARAATGATAGGRGGA (SEQ ID NO: 10033) |
| 50 | GAHATRRRKTTRCCAGGRARATGGAARCCAAAAATRATAGGGGGA (SEQ ID NO: 10034) |
| 50 | RRRWTTRCCAGGRARATGGAAACCAARAATGATAGGRGGA + N (SEQ ID NO: 10035) |
| 50 | GGRARATGGAAACCAARAATGATAGGRGGA + N (SEQ ID NO: 10036) |
| 50 | GRARATGGAAACCAARAATGATAGGRGGA + N (SEQ ID NO: 10037) |
| 50 | TGGAAACCAARAATGATAGGRGGA + N (SEQ ID NO: 10038) |
| 50 | GGAAACCAARAATGATAGGRGGA + N (SEQ ID NO: 10039) |
| 50 | GAAACCAARAATGATAGGRGGA + N (SEQ ID NO: 10040) |
| 50 | GAHATRRRKTTRCCAGGRARATGGAARCCAAAAATRATAGGGGGA + N (SEQ ID NO: 10041) |
| 53 | +GRARA + T + GGAAACCAARAATGATAGGRGGAATTGGAGGYTT (SEQ ID NO: 10042) |
| 53 | +GRARAT + G + GAAACCAARAATGATAGGRGGAATTGGAGGYTT (SEQ ID NO: 10043) |
| 53 | +GRARA + TG + GAAACCAARAATGATAGGRGGAATTGGAGGYTT (SEQ ID NO: 10044) |
| 53 | +T + G + GAAACCAARAATGATAGGRGGAATTGGAGGYTT (SEQ ID NO: 10045) |
| 53 | +TG + G + AAACCAARAATGATAGGRGGAATTGGAGGYTT (SEQ ID NO: 10046) |
| 53 | +T + GG + AAACCAARAATGATAGGRGGAATTGGAGGYTT (SEQ ID NO: 10047) |
| 53 | +G + G + AAACCAARAATGATAGGRGGAATTGGAGGYTT (SEQ ID NO: 10048) |
| 53 | +GG + AAA + CCAARAATGATAGGRGGAATTGGAGGYTT (SEQ ID NO: 10049) |
| 53 | +G + GAAA + CCAARAATGATAGGRGGAATTGGAGGYTT (SEQ ID NO: 10050) |
| 53 | +G + AAA + CCAARAATGATAGGRGGAATTGGAGGYTT (SEQ ID NO: 10051) |
| 53 | +GAAA + C + CAARAATGATAGGRGGAATTGGAGGYTT (SEQ ID NO: 10052) |
| 53 | +G + AAAC + CAARAATGATAGGRGGAATTGGAGGYTT (SEQ ID NO: 10053) |
| 53 | +AAA + C + CAARAATGATAGGRGGAATTGGAGGYTT (SEQ ID NO: 10054) |
| 53 | +AAAC + CA + ARAATGATAGGRGGAATTGGAGGYTT (SEQ ID NO: 10055) |
| 53 | +AAA + CCA + ARAATGATAGGRGGAATTGGAGGYTT (SEQ ID NO: 10056) |
| 53 | +C + CA + ARAATGATAGGRGGAATTGGAGGYTT (SEQ ID NO: 10057) |
| 53 | +CCA + ARAA + TGATAGGRGGAATTGGAGGYTT (SEQ ID NO: 10058) |
| 53 | +C + CAARAA + TGATAGGRGGAATTGGAGGYTT (SEQ ID NO: 10059) |
| 53 | +G + GRARA + TGGAAACCAARAATGATAGGRGGAATTGGAGGYT (SEQ ID NO: 10060) |
| 53 | +GGRARA + T + GGAAACCAARAATGATAGGRGGAATTGGAGGYT (SEQ ID NO: 10061) |
| 53 | +G + GRARAT + GGAAACCAARAATGATAGGRGGAATTGGAGGYT (SEQ ID NO: 10062) |

TABLE 8-continued

| Codon | |
|---|---|
| 53 | +GRARA + T + GGAAACCAARAATGATAGGRGGAATTGGAGGYT (SEQ ID NO: 10063) |
| 53 | +GRARAT + G + GAAACCAARAATGATAGGRGGAATTGGAGGYT (SEQ ID NO: 10064) |
| 53 | +GRARA + TG + GAAACCAARAATGATAGGRGGAATTGGAGGYT (SEQ ID NO: 10065) |
| 53 | +T + G + GAAACCAARAATGATAGGRGGAATTGGAGGYT (SEQ ID NO: 10066) |
| 53 | +TG + G + AAACCAARAATGATAGGRGGAATTGGAGGYT (SEQ ID NO: 10067) |
| 53 | +T + GG + AAACCAARAATGATAGGRGGAATTGGAGGYT (SEQ ID NO: 10068) |
| 53 | +G + G + AAACCAARAATGATAGGRGGAATTGGAGGYT (SEQ ID NO: 10069) |
| 53 | +GG + AAA + CCAARAATGATAGGRGGAATTGGAGGYT (SEQ ID NO: 10070) |
| 53 | +G + GAAA + CCAARAATGATAGGRGGAATTGGAGGYT (SEQ ID NO: 10071) |
| 53 | +G + AAA + CCAARAATGATAGGRGGAATTGGAGGYT (SEQ ID NO: 10072) |
| 53 | +GAAA + C + CAARAATGATAGGRGGAATTGGAGGYT (SEQ ID NO: 10073) |
| 53 | +G + AAAC + CAARAATGATAGGRGGAATTGGAGGYT (SEQ ID NO: 10074) |
| 53 | +AAA + C + CAARAATGATAGGRGGAATTGGAGGYT (SEQ ID NO: 10075) |
| 53 | +AAAC + CA + ARAATGATAGGRGGAATTGGAGGYT (SEQ ID NO: 10076) |
| 53 | +AAA + CCA + ARAATGATAGGRGGAATTGGAGGYT (SEQ ID NO: 10077) |
| 53 | GRARATGGAAACCAARAATGATAGGRGGAATTGGAGGYTT (SEQ ID NO: 10078) |
| 53 | TGGAAACCAARAATGATAGGRGGAATTGGAGGYTT (SEQ ID NO: 10079) |
| 53 | GGAAACCAARAATGATAGGRGGAATTGGAGGYTT (SEQ ID NO: 10080) |
| 53 | GAAACCAARAATGATAGGRGGAATTGGAGGYTT (SEQ ID NO: 10081) |
| 53 | AAACCAARAATGATAGGRGGAATTGGAGGYTT (SEQ ID NO: 10082) |
| 53 | CCAARAATGATAGGRGGAATTGGAGGYTT (SEQ ID NO: 10083) |
| 53 | GGRARATGGAAACCAARAATGATAGGRGGAATTGGAGGYT (SEQ ID NO: 10084) |
| 53 | GRARATGGAAACCAARAATGATAGGRGGAATTGGAGGYT (SEQ ID NO: 10085) |
| 53 | TGGAAACCAARAATGATAGGRGGAATTGGAGGYT (SEQ ID NO: 10086) |
| 53 | GGAAACCAARAATGATAGGRGGAATTGGAGGYT (SEQ ID NO: 10087) |
| 53 | GAAACCAARAATGATAGGRGGAATTGGAGGYT (SEQ ID NO: 10088) |
| 53 | AAACCAARAATGATAGGRGGAATTGGAGGYT (SEQ ID NO: 10089) |
| 53 | TTRCCAGGRARATGGAARCCAAAAATRATAGGRGGAATTGGAGGT (SEQ ID NO: 10090) |
| 53 | GRARATGGAAACCAARAATGATAGGRGGAATTGGAGGYTT + N (SEQ ID NO: 10091) |
| 53 | TGGAAACCAARAATGATAGGRGGAATTGGAGGYTT + N (SEQ ID NO: 10092) |
| 53 | GGAAACCAARAATGATAGGRGGAATTGGAGGYTT + N (SEQ ID NO: 10093) |
| 53 | GAAACCAARAATGATAGGRGGAATTGGAGGYTT + N (SEQ ID NO: 10094) |
| 53 | AAACCAARAATGATAGGRGGAATTGGAGGYTT + N (SEQ ID NO: 10095) |
| 53 | CCAARAATGATAGGRGGAATTGGAGGYTT + N (SEQ ID NO: 10096) |
| 53 | GGRARATGGAAACCAARAATGATAGGRGGAATTGGAGGYT + N (SEQ ID NO: 10097) |
| 53 | GRARATGGAAACCAARAATGATAGGRGGAATTGGAGGYT + N (SEQ ID NO: 10098) |
| 53 | TGGAAACCAARAATGATAGGRGGAATTGGAGGYT + N (SEQ ID NO: 10099) |
| 53 | GGAAACCAARAATGATAGGRGGAATTGGAGGYT + N (SEQ ID NO: 10100) |
| 53 | GAAACCAARAATGATAGGRGGAATTGGAGGYT + N (SEQ ID NO: 10101) |

TABLE 8-continued

| Codon | |
|---|---|
| 53 | AAACCAARAATGATAGGRGGAATTGGAGGYT + N (SEQ ID NO: 10102) |
| 53 | TTRCCAGGRARATGGAARCCAAAAATRATAGGRGGAATTGGAGGT + N (SEQ ID NO: 10103) |
| 54 | RA + T + G + GAAACCAARAATGATAGGRGGAATTGGAGGYTTTAT (SEQ ID NO: 10104) |
| 54 | RA + TG + G + AAACCAARAATGATAGGRGGAATTGGAGGYTTTAT (SEQ ID NO: 10105) |
| 54 | RA + T + GG + AAACCAARAATGATAGGRGGAATTGGAGGYTTTAT (SEQ ID NO: 10106) |
| 54 | +G + G + AAACCAARAATGATAGGRGGAATTGGAGGYTTTAT (SEQ ID NO: 10107) |
| 54 | +GG + AAA + CCAARAATGATAGGRGGAATTGGAGGYTTTAT (SEQ ID NO: 10108) |
| 54 | +G + GAAA + CCAARAATGATAGGRGGAATTGGAGGYTTTAT (SEQ ID NO: 10109) |
| 54 | +G + AAA + CCAARAATGATAGGRGGAATTGGAGGYTTTAT (SEQ ID NO: 10110) |
| 54 | +GAAA + C + CAARAATGATAGGRGGAATTGGAGGYTTTAT (SEQ ID NO: 10111) |
| 54 | +G + AAAC + CAARAATGATAGGRGGAATTGGAGGYTTTAT (SEQ ID NO: 10112) |
| 54 | +AAA + C + CAARAATGATAGGRGGAATTGGAGGYTTTAT (SEQ ID NO: 10113) |
| 54 | +AAAC + CA + ARAATGATAGGRGGAATTGGAGGYTTTAT (SEQ ID NO: 10114) |
| 54 | +AAA + CCA + ARAATGATAGGRGGAATTGGAGGYTTTAT (SEQ ID NO: 10115) |
| 54 | +C + CA + ARAATGATAGGRGGAATTGGAGGYTTTAT (SEQ ID NO: 10116) |
| 54 | +CCA + ARAA + TGATAGGRGGAATTGGAGGYTTTAT (SEQ ID NO: 10117) |
| 54 | +C + CAARAA + TGATAGGRGGAATTGGAGGYTTTAT (SEQ ID NO: 10118) |
| 54 | +CA + ARAA + TGATAGGRGGAATTGGAGGYTTTAT (SEQ ID NO: 10119) |
| 54 | +CAARAA + TG + ATAGGRGGAATTGGAGGYTTTAT (SEQ ID NO: 10120) |
| 54 | +CA + ARAATG + ATAGGRGGAATTGGAGGYTTTAT (SEQ ID NO: 10121) |
| 54 | ARA + T + G + GAAACCAARAATGATAGGRGGAATTGGAGGYTTTA (SEQ ID NO: 10122) |
| 54 | ARA + TG + G + AAACCAARAATGATAGGRGGAATTGGAGGYTTTA (SEQ ID NO: 10123) |
| 54 | ARA + T + GG + AAACCAARAATGATAGGRGGAATTGGAGGYTTTA (SEQ ID NO: 10124) |
| 54 | +G + G + AAACCAARAATGATAGGRGGAATTGGAGGYTTTA (SEQ ID NO: 10125) |
| 54 | +GG + AAA + CCAARAATGATAGGRGGAATTGGAGGYTTTA (SEQ ID NO: 10126) |
| 54 | +G + GAAA + CCAARAATGATAGGRGGAATTGGAGGYTTTA (SEQ ID NO: 10127) |
| 54 | +G + AAA + CCAARAATGATAGGRGGAATTGGAGGYTTTA (SEQ ID NO: 10128) |
| 54 | +GAAA + C + CAARAATGATAGGRGGAATTGGAGGYTTTA (SEQ ID NO: 10129) |
| 54 | +G + AAAC + CAARAATGATAGGRGGAATTGGAGGYTTTA (SEQ ID NO: 10130) |
| 54 | +AAA + C + CAARAATGATAGGRGGAATTGGAGGYTTTA (SEQ ID NO: 10131) |
| 54 | +AAAC + CA + ARAATGATAGGRGGAATTGGAGGYTTTA (SEQ ID NO: 10132) |
| 54 | +AAA + CCA + ARAATGATAGGRGGAATTGGAGGYTTTA (SEQ ID NO: 10133) |
| 54 | +C + CA + ARAATGATAGGRGGAATTGGAGGYTTTA (SEQ ID NO: 10134) |
| 54 | +CCA + ARAA + TGATAGGRGGAATTGGAGGYTTTA (SEQ ID NO: 10135) |
| 54 | +C + CAARAA + TGATAGGRGGAATTGGAGGYTTTA (SEQ ID NO: 10136) |
| 54 | +CA + ARAA + TGATAGGRGGAATTGGAGGYTTTA (SEQ ID NO: 10137) |
| 54 | +CAARAA + TG + ATAGGRGGAATTGGAGGYTTTA (SEQ ID NO: 10138) |
| 54 | +CA + ARAATG + ATAGGRGGAATTGGAGGYTTTA (SEQ ID NO: 10139) |
| 54 | RARA + T + G + GAAACCAARAATGATAGGRGGAATTGGAGGYTTT (SEQ ID NO: 10140) |

TABLE 8-continued

| Codon | |
|---|---|
| 54 | RARA + TG + G + AAACCAARAATGATAGGRGGAATTGGAGGYTTT (SEQ ID NO: 10141) |
| 54 | RARA + T + GG + AAACCAARAATGATAGGRGGAATTGGAGGYTTT (SEQ ID NO: 10142) |
| 54 | +G + G + AAACCAARAATGATAGGRGGAATTGGAGGYTTT (SEQ ID NO: 10143) |
| 54 | +GG + AAA + CCAARAATGATAGGRGGAATTGGAGGYTTT (SEQ ID NO: 10144) |
| 54 | +G + GAAA + CCAARAATGATAGGRGGAATTGGAGGYTTT (SEQ ID NO: 10145) |
| 54 | +G + AAA + CCAARAATGATAGGRGGAATTGGAGGYTTT (SEQ ID NO: 10146) |
| 54 | +GAAA + C + CAARAATGATAGGRGGAATTGGAGGYTTT (SEQ ID NO: 10147) |
| 54 | +G + AAAC + CAARAATGATAGGRGGAATTGGAGGYTTT (SEQ ID NO: 10148) |
| 54 | +AAA + C + CAARAATGATAGGRGGAATTGGAGGYTTT (SEQ ID NO: 10149) |
| 54 | +AAAC + CA + ARAATGATAGGRGGAATTGGAGGYTTT (SEQ ID NO: 10150) |
| 54 | +AAA + CCA + ARAATGATAGGRGGAATTGGAGGYTTT (SEQ ID NO: 10151) |
| 54 | +C + CA + ARAATGATAGGRGGAATTGGAGGYTTT (SEQ ID NO: 10152) |
| 54 | +CCA + ARAA + TGATAGGRGGAATTGGAGGYTTT (SEQ ID NO: 10153) |
| 54 | +C + CAARAA + TGATAGGRGGAATTGGAGGYTTT (SEQ ID NO: 10154) |
| 54 | +CA + ARAA + TGATAGGRGGAATTGGAGGYTTT (SEQ ID NO: 10155) |
| 54 | +CAARAA + TG + ATAGGRGGAATTGGAGGYTTT (SEQ ID NO: 10156) |
| 54 | +CA + ARAATG + ATAGGRGGAATTGGAGGYTTT (SEQ ID NO: 10157) |
| 54 | RATGGAAACCAARAATGATAGGRGGAATTGGAGGYTTTAT (SEQ ID NO: 10158) |
| 54 | GGAAACCAARAATGATAGGRGGAATTGGAGGYTTTAT (SEQ ID NO: 10159) |
| 54 | GAAACCAARAATGATAGGRGGAATTGGAGGYTTTAT (SEQ ID NO: 10160) |
| 54 | AAACCAARAATGATAGGRGGAATTGGAGGYTTTAT (SEQ ID NO: 10161) |
| 54 | CCAARAATGATAGGRGGAATTGGAGGYTTTAT (SEQ ID NO: 10162) |
| 54 | CAARAATGATAGGRGGAATTGGAGGYTTTAT (SEQ ID NO: 10163) |
| 54 | ARATGGAAACCAARAATGATAGGRGGAATTGGAGGYTTTA (SEQ ID NO: 10164) |
| 54 | GGAAACCAARAATGATAGGRGGAATTGGAGGYTTTA (SEQ ID NO: 10165) |
| 54 | GAAACCAARAATGATAGGRGGAATTGGAGGYTTTA (SEQ ID NO: 10166) |
| 54 | AAACCAARAATGATAGGRGGAATTGGAGGYTTTA (SEQ ID NO: 10167) |
| 54 | CCAARAATGATAGGRGGAATTGGAGGYTTTA (SEQ ID NO: 10168) |
| 54 | CAARAATGATAGGRGGAATTGGAGGYTTTA (SEQ ID NO: 10169) |
| 54 | RARATGGAAACCAARAATGATAGGRGGAATTGGAGGYTTT (SEQ ID NO: 10170) |
| 54 | GGAAACCAARAATGATAGGRGGAATTGGAGGYTTT (SEQ ID NO: 10171) |
| 54 | GAAACCAARAATGATAGGRGGAATTGGAGGYTTT (SEQ ID NO: 10172) |
| 54 | AAACCAARAATGATAGGRGGAATTGGAGGYTTT (SEQ ID NO: 10173) |
| 54 | CCAARAATGATAGGRGGAATTGGAGGYTTT (SEQ ID NO: 10174) |
| 54 | CAARAATGATAGGRGGAATTGGAGGYTTT (SEQ ID NO: 10175) |
| 54 | CCAGGRARATGGAARCCAAAAATRATAGGRGGAATTGGAGGTTTT (SEQ ID NO: 10176) |
| 54 | RATGGAAACCAARAATGATAGGRGGAATTGGAGGYTTTAT + N (SEQ ID NO: 10177) |
| 54 | GGAAACCAARAATGATAGGRGGAATTGGAGGYTTTAT + N (SEQ ID NO: 10178) |
| 54 | GAAACCAARAATGATAGGRGGAATTGGAGGYTTTAT + N (SEQ ID NO: 10179) |

TABLE 8-continued

| Codon | |
|---|---|
| 54 | AAACCAARAATGATAGGRGGAATTGGAGGYTTTAT + N (SEQ ID NO: 10180) |
| 54 | CCAARAATGATAGGRGGAATTGGAGGYTTTAT + N (SEQ ID NO: 10181) |
| 54 | CAARAATGATAGGRGGAATTGGAGGYTTTAT + N (SEQ ID NO: 10182) |
| 54 | ARATGGAAACCAARAATGATAGGRGGAATTGGAGGYTTTA + N (SEQ ID NO: 10183) |
| 54 | GGAAACCAARAATGATAGGRGGAATTGGAGGYTTTA + N (SEQ ID NO: 10184) |
| 54 | GAAACCAARAATGATAGGRGGAATTGGAGGYTTTA + N (SEQ ID NO: 10185) |
| 54 | AAACCAARAATGATAGGRGGAATTGGAGGYTTTA + N (SEQ ID NO: 10186) |
| 54 | CCAARAATGATAGGRGGAATTGGAGGYTTTA + N (SEQ ID NO: 10187) |
| 54 | CAARAATGATAGGRGGAATTGGAGGYTTTA + N (SEQ ID NO: 10188) |
| 54 | RARATGGAAACCAARAATGATAGGRGGAATTGGAGGYTTT + N (SEQ ID NO: 10189) |
| 54 | GGAAACCAARAATGATAGGRGGAATTGGAGGYTTT + N (SEQ ID NO: 10190) |
| 54 | GAAACCAARAATGATAGGRGGAATTGGAGGYTTT + N (SEQ ID NO: 10191) |
| 54 | AAACCAARAATGATAGGRGGAATTGGAGGYTTT + N (SEQ ID NO: 10192) |
| 54 | CCAARAATGATAGGRGGAATTGGAGGYTTT + N (SEQ ID NO: 10193) |
| 54 | CAARAATGATAGGRGGAATTGGAGGYTTT + N (SEQ ID NO: 10194) |
| 54 | CCAGGRARATGGAARCCAAAAATRATAGGRGGAATTGGAGGTTTT + N (SEQ ID NO: 10195) |
| 58 | A + ARAA + TG + ATAGGRGGAATTGGAGGYTTTATYAARGTAARR (SEQ ID NO: 10196) |
| 58 | A + ARAATG + A + TAGGRGGAATTGGAGGYTTTATYAARGTAARR (SEQ ID NO: 10197) |
| 58 | A + ARAA + TGA + TAGGRGGAATTGGAGGYTTTATYAARGTAARR (SEQ ID NO: 10198) |
| 58 | +TG + A + TAGGRGGAATTGGAGGYTTTATYAARGTAARR (SEQ ID NO: 10199) |
| 58 | +TGA + T + AGGRGGAATTGGAGGYTTTATYAARGTAARR (SEQ ID NO: 10200) |
| 58 | +TG + AT + AGGRGGAATTGGAGGYTTTATYAARGTAARR (SEQ ID NO: 10201) |
| 58 | +A + T + AGGRGGAATTGGAGGYTTTATYAARGTAARR (SEQ ID NO: 10202) |
| 58 | +AT + A + GGRGGAATTGGAGGYTTTATYAARGTAARR (SEQ ID NO: 10203) |
| 58 | +A + TA + GGRGGAATTGGAGGYTTTATYAARGTAARR (SEQ ID NO: 10204) |
| 58 | +T + A + GGRGGAATTGGAGGYTTTATYAARGTAARR (SEQ ID NO: 10205) |
| 58 | +TA + G + GRGGAATTGGAGGYTTTATYAARGTAARR (SEQ ID NO: 10206) |
| 58 | +T + AG + GRGGAATTGGAGGYTTTATYAARGTAARR (SEQ ID NO: 10207) |
| 58 | +A + G + GRGGAATTGGAGGYTTTATYAARGTAARR (SEQ ID NO: 10208) |
| 58 | +AG + GR + GGAATTGGAGGYTTTATYAARGTAARR (SEQ ID NO: 10209) |
| 58 | +A + GGR + GGAATTGGAGGYTTTATYAARGTAARR (SEQ ID NO: 10210) |
| 58 | +G + GR + GGAATTGGAGGYTTTATYAARGTAARR (SEQ ID NO: 10211) |
| 58 | +GGR + G + GAATTGGAGGYTTTATYAARGTAARR (SEQ ID NO: 10212) |
| 58 | +G + GRG + GAATTGGAGGYTTTATYAARGTAARR (SEQ ID NO: 10213) |
| 58 | AARAATGATAGGRGGAATTGGAGGYTTTATYAARGTAARR (SEQ ID NO: 10214) |
| 58 | TGATAGGRGGAATTGGAGGYTTTATYAARGTAARR (SEQ ID NO: 10215) |
| 58 | ATAGGRGGAATTGGAGGYTTTATYAARGTAARR (SEQ ID NO: 10216) |
| 58 | TAGGRGGAATTGGAGGYTTTATYAARGTAARR (SEQ ID NO: 10217) |
| 58 | AGGRGGAATTGGAGGYTTTATYAARGTAARR (SEQ ID NO: 10218) |

TABLE 8-continued

| Codon | |
|---|---|
| 58 | GGRGGAATTGGAGGYTTTATYAARGTAARR (SEQ ID NO: 10219) |
| 58 | AARCCAAAAATRATAGGRGGAATTGGAGGYTTTRTYAAAGTAAGA (SEQ ID NO: 10220) |
| 58 | AARAATGATAGGRGGAATTGGAGGYTTTATYAARGTAARR + N (SEQ ID NO: 10221) |
| 58 | TGATAGGRGGAATTGGAGGYTTTATYAARGTAARR + N (SEQ ID NO: 10222) |
| 58 | ATAGGRGGAATTGGAGGYTTTATYAARGTAARR + N (SEQ ID NO: 10223) |
| 58 | TAGGRGGAATTGGAGGYTTTATYAARGTAARR + N (SEQ ID NO: 10224) |
| 58 | AGGRGGAATTGGAGGYTTTATYAARGTAARR + N (SEQ ID NO: 10225) |
| 58 | GGRGGAATTGGAGGYTTTATYAARGTAARR + N (SEQ ID NO: 10226) |
| 58 | AARCCAAAAATRATAGGRGGAATTGGAGGYTTTRTYAAAGTAAGA + N (SEQ ID NO: 10227) |
| 71 | RC + AR + T + ATGAKSARRTANYYATAGAAATYTGTGGRMAWARR (SEQ ID NO: 10228) |
| 71 | RC + ART + AT + GAKSARRTANYYATAGAAATYTGTGGRMAWARR (SEQ ID NO: 10229) |
| 71 | RC + AR + TAT + GAKSARRTANYYATAGAAATYTGTGGRMAWARR (SEQ ID NO: 10230) |
| 71 | +T + AT + GAKSARRTANYYATAGAAATYTGTGGRMAWARR (SEQ ID NO: 10231) |
| 71 | +TAT + G + AKSARRTANYYATAGAAATYTGTGGRMAWARR (SEQ ID NO: 10232) |
| 71 | +T + ATG + AKSARRTANYYATAGAAATYTGTGGRMAWARR (SEQ ID NO: 10233) |
| 71 | +AT + G + AKSARRTANYYATAGAAATYTGTGGRMAWARR (SEQ ID NO: 10234) |
| 71 | +ATG + AKS + ARRTANYYATAGAAATYTGTGGRMAWARR (SEQ ID NO: 10235) |
| 71 | +AT + GAKS + ARRTANYYATAGAAATYTGTGGRMAWARR (SEQ ID NO: 10236) |
| 71 | +G + AKS + ARRTANYYATAGAAATYTGTGGRMAWARR (SEQ ID NO: 10237) |
| 71 | +GAKS + ARR + TANYYATAGAAATYTGTGGRMAWARR (SEQ ID NO: 10238) |
| 71 | +G + AKSARR + TANYYATAGAAATYTGTGGRMAWARR (SEQ ID NO: 10239) |
| 71 | +AKS + ARR + TANYYATAGAAATYTGTGGRMAWARR (SEQ ID NO: 10240) |
| 71 | +AKSARR + TANYYA + TAGAAATYTGTGGRMAWARR (SEQ ID NO: 10241) |
| 71 | +AKS + ARRTANYYA + TAGAAATYTGTGGRMAWARR (SEQ ID NO: 10242) |
| 71 | +ARR + TANYYA + TAGAAATYTGTGGRMAWARR (SEQ ID NO: 10243) |
| 71 | +ARRTANYYA + TA + GAAATYTGTGGRMAWARR (SEQ ID NO: 10244) |
| 71 | +ARR + TANYYATA + GAAATYTGTGGRMAWARR (SEQ ID NO: 10245) |
| 71 | RCARTATGAKSARRTANYYATAGAAATYTGTGGRMAWARR (SEQ ID NO: 10246) |
| 71 | TATGAKSARRTANYYATAGAAATYTGTGGRMAWARR (SEQ ID NO: 10247) |
| 71 | ATGAKSARRTANYYATAGAAATYTGTGGRMAWARR (SEQ ID NO: 10248) |
| 71 | GAKSARRTANYYATAGAAATYTGTGGRMAWARR (SEQ ID NO: 10249) |
| 71 | AKSARRTANYYATAGAAATYTGTGGRMAWARR (SEQ ID NO: 10250) |
| 71 | ARRTANYYATAGAAATYTGTGGRMAWARR (SEQ ID NO: 10251) |
| 71 | GTAARRCARTATGAKSAVRTANHHRTAGARATYTGYGGRCATAAA (SEQ ID NO: 10252) |
| 71 | RCARTATGAKSARRTANYYATAGAAATYTGTGGRMAWARR + N (SEQ ID NO: 10253) |
| 71 | TATGAKSARRTANYYATAGAAATYTGTGGRMAWARR + N (SEQ ID NO: 10254) |
| 71 | ATGAKSARRTANYYATAGAAATYTGTGGRMAWARR + N (SEQ ID NO: 10255) |
| 71 | GAKSARRTANYYATAGAAATYTGTGGRMAWARR + N (SEQ ID NO: 10256) |
| 71 | AKSARRTANYYATAGAAATYTGTGGRMAWARR + N (SEQ ID NO: 10257) |

TABLE 8-continued

| Codon | |
|---|---|
| 71 | ARRTANYYATAGAAATYTGTGGRMAWARR + N (SEQ ID NO: 10258) |
| 71 | GTAARRCARTATGAKSAVRTANHHRTAGARATYTGYGGRCATAAA + N (SEQ ID NO: 10259) |
| 73 | +G + AKS + ARRTANYYATAGAAATYTGTGGRMAWARRGCYATAG (SEQ ID NO: 10260) |
| 73 | +GAKS + ARR + TANYYATAGAAATYTGTGGRMAWARRGCYATAG (SEQ ID NO: 10261) |
| 73 | +G + AKSARR + TANYYATAGAAATYTGTGGRMAWARRGCYATAG (SEQ ID NO: 10262) |
| 73 | +AKS + ARR + TANYYATAGAAATYTGTGGRMAWARRGCYATAG (SEQ ID NO: 10263) |
| 73 | +AKSARR + TANYYA + TAGAAATYTGTGGRMAWARRGCYATAG (SEQ ID NO: 10264) |
| 73 | +AKS + ARRTANYYA + TAGAAATYTGTGGRMAWARRGCYATAG (SEQ ID NO: 10265) |
| 73 | +ARR + TANYYA + TAGAAATYTGTGGRMAWARRGCYATAG (SEQ ID NO: 10266) |
| 73 | +ARRTANYYA + TA + GAAATYTGTGGRMAWARRGCYATAG (SEQ ID NO: 10267) |
| 73 | +ARR + TANYYATA + GAAATYTGTGGRMAWARRGCYATAG (SEQ ID NO: 10268) |
| 73 | +TANYYA + TA + GAAATYTGTGGRMAWARRGCYATAG (SEQ ID NO: 10269) |
| 73 | +TANYYATA + G + AAATYTGTGGRMAWARRGCYATAG (SEQ ID NO: 10270) |
| 73 | +TANYYA + TAG + AAATYTGTGGRMAWARRGCYATAG (SEQ ID NO: 10271) |
| 73 | +TA + G + AAATYTGTGGRMAWARRGCYATAG (SEQ ID NO: 10272) |
| 73 | +TAG + AAA + TYTGTGGRMAWARRGCYATAG (SEQ ID NO: 10273) |
| 73 | +TA + GAAA + TYTGTGGRMAWARRGCYATAG (SEQ ID NO: 10274) |
| 73 | +G + AAA + TYTGTGGRMAWARRGCYATAG (SEQ ID NO: 10275) |
| 73 | +GAAA + TYTGT + GGRMAWARRGCYATAG (SEQ ID NO: 10276) |
| 73 | +G + AAATYTGT + GGRMAWARRGCYATAG (SEQ ID NO: 10277) |
| 73 | T + G + AKS + ARRTANYYATAGAAATYTGTGGRMAWARRGCYATA (SEQ ID NO: 10278) |
| 73 | T + GAKS + ARR + TANYYATAGAAATYTGTGGRMAWARRGCYATA (SEQ ID NO: 10279) |
| 73 | T + G + AKSARR + TANYYATAGAAATYTGTGGRMAWARRGCYATA (SEQ ID NO: 10280) |
| 73 | +AKS + ARR + TANYYATAGAAATYTGTGGRMAWARRGCYATA (SEQ ID NO: 10281) |
| 73 | +AKSARR + TANYYA + TAGAAATYTGTGGRMAWARRGCYATA (SEQ ID NO: 10282) |
| 73 | +AKS + ARRTANYYA + TAGAAATYTGTGGRMAWARRGCYATA (SEQ ID NO: 10283) |
| 73 | +ARR + TANYYA + TAGAAATYTGTGGRMAWARRGCYATA (SEQ ID NO: 10284) |
| 73 | +ARRTANYYA + TA + GAAATYTGTGGRMAWARRGCYATA (SEQ ID NO: 10285) |
| 73 | +ARR + TANYYATA + GAAATYTGTGGRMAWARRGCYATA (SEQ ID NO: 10286) |
| 73 | +TANYYA + TA + GAAATYTGTGGRMAWARRGCYATA (SEQ ID NO: 10287) |
| 73 | +TANYYATA + G + AAATYTGTGGRMAWARRGCYATA (SEQ ID NO: 10288) |
| 73 | +TANYYA + TAG + AAATYTGTGGRMAWARRGCYATA (SEQ ID NO: 10289) |
| 73 | +TA + G + AAATYTGTGGRMAWARRGCYATA (SEQ ID NO: 10290) |
| 73 | +TAG + AAA + TYTGTGGRMAWARRGCYATA (SEQ ID NO: 10291) |
| 73 | +TA + GAAA + TYTGTGGRMAWARRGCYATA (SEQ ID NO: 10292) |
| 73 | +G + AAA + TYTGTGGRMAWARRGCYATA (SEQ ID NO: 10293) |
| 73 | +GAAA + TYTGT + GGRMAWARRGCYATA (SEQ ID NO: 10294) |
| 73 | +G + AAATYTGT + GGRMAWARRGCYATA (SEQ ID NO: 10295) |
| 73 | GAKSARRTANYYATAGAAATYTGTGGRMAWARRGCYATAG (SEQ ID NO: 10296) |

TABLE 8-continued

| Codon | |
|---|---|
| 73 | AKSARRTANYYATAGAAATYTGTGGRMAWARRGCYATAG (SEQ ID NO: 10297) |
| 73 | ARRTANYYATAGAAATYTGTGGRMAWARRGCYATAG (SEQ ID NO: 10298) |
| 73 | TANYYATAGAAATYTGTGGRMAWARRGCYATAG (SEQ ID NO: 10299) |
| 73 | TAGAAATYTGTGGRMAWARRGCYATAG (SEQ ID NO: 10300) |
| 73 | GAAATYTGTGGRMAWARRGCYATAG (SEQ ID NO: 10301) |
| 73 | TGAKSARRTANYYATAGAAATYTGTGGRMAWARRGCYATA (SEQ ID NO: 10302) |
| 73 | AKSARRTANYYATAGAAATYTGTGGRMAWARRGCYATA (SEQ ID NO: 10303) |
| 73 | ARRTANYYATAGAAATYTGTGGRMAWARRGCYATA (SEQ ID NO: 10304) |
| 73 | TANYYATAGAAATYTGTGGRMAWARRGCYATA (SEQ ID NO: 10305) |
| 73 | TAGAAATYTGTGGRMAWARRGCYATA (SEQ ID NO: 10306) |
| 73 | GAAATYTGTGGRMAWARRGCYATA (SEQ ID NO: 10307) |
| 73 | CARTATGAKSAVRTANHHRTAGARATYTGYGGRMAHARRGCTATA (SEQ ID NO: 10308) |
| 73 | GAKSARRTANYYATAGAAATYTGTGGRMAWARRGCYATAG + N (SEQ ID NO: 10309) |
| 73 | AKSARRTANYYATAGAAATYTGTGGRMAWARRGCYATAG + N (SEQ ID NO: 10310) |
| 73 | ARRTANYYATAGAAATYTGTGGRMAWARRGCYATAG + N (SEQ ID NO: 10311) |
| 73 | TANYYATAGAAATYTGTGGRMAWARRGCYATAG + N (SEQ ID NO: 10312) |
| 73 | TAGAAATYTGTGGRMAWARRGCYATAG + N (SEQ ID NO: 10313) |
| 73 | GAAATYTGTGGRMAWARRGCYATAG + N (SEQ ID NO: 10314) |
| 73 | TGAKSARRTANYYATAGAAATYTGTGGRMAWARRGCYATA + N (SEQ ID NO: 10315) |
| 73 | AKSARRTANYYATAGAAATYTGTGGRMAWARRGCYATA + N (SEQ ID NO: 10316) |
| 73 | ARRTANYYATAGAAATYTGTGGRMAWARRGCYATA + N (SEQ ID NO: 10317) |
| 73 | TANYYATAGAAATYTGTGGRMAWARRGCYATA + N (SEQ ID NO: 10318) |
| 73 | TAGAAATYTGTGGRMAWARRGCYATA + N (SEQ ID NO: 10319) |
| 73 | GAAATYTGTGGRMAWARRGCYATA + N (SEQ ID NO: 10320) |
| 73 | CARTATGAKSAVRTANHHRTAGARATYTGYGGRMAHARRGCTATA + N (SEQ ID NO: 10321) |
| 74 | KS + ARR + TANYYA + TAGAAATYTGTGGRMAWARRGCYATAGGK (SEQ ID NO: 10322) |
| 74 | KS + ARRTANYYA + TA + GAAATYTGTGGRMAWARRGCYATAGGK (SEQ ID NO: 10323) |
| 74 | KS + ARR + TANYYATA + GAAATYTGTGGRMAWARRGCYATAGGK (SEQ ID NO: 10324) |
| 74 | +TANYYA + TA + GAAATYTGTGGRMAWARRGCYATAGGK (SEQ ID NO: 10325) |
| 74 | +TANYYATA + G + AAATYTGTGGRMAWARRGCYATAGGK (SEQ ID NO: 10326) |
| 74 | +TANYYA + TAG + AAATYTGTGGRMAWARRGCYATAGGK (SEQ ID NO: 10327) |
| 74 | +TA + G + AAATYTGTGGRMAWARRGCYATAGGK (SEQ ID NO: 10328) |
| 74 | +TAG + AAA + TYTGTGGRMAWARRGCYATAGGK (SEQ ID NO: 10329) |
| 74 | +TA + GAAA + TYTGTGGRMAWARRGCYATAGGK (SEQ ID NO: 10330) |
| 74 | +G + AAA + TYTGTGGRMAWARRGCYATAGGK (SEQ ID NO: 10331) |
| 74 | +GAAA + TYTGT + GGRMAWARRGCYATAGGK (SEQ ID NO: 10332) |
| 74 | +G + AAATYTGT + GGRMAWARRGCYATAGGK (SEQ ID NO: 10333) |
| 74 | +AAA + TYTGT + GGRMAWARRGCYATAGGK (SEQ ID NO: 10334) |
| 74 | +AAATYTGT + GGRMAWARRGCYATAG + GK (SEQ ID NO: 10335) |

TABLE 8-continued

| Codon | |
|---|---|
| 74 | +AAA + TYTGTGGRMAWARRGCYATAG + GK (SEQ ID NO: 10336) |
| 74 | +TYTGT + GGRMAWARRGCYATAG + GK (SEQ ID NO: 10337) |
| 74 | +TYTGTGGRMAWARRGCYATAG + GK (SEQ ID NO: 10338) |
| 74 | +TYTGT + GGRMAWARRGCYATAGGK (SEQ ID NO: 10339) |
| 74 | KSARRTANYYATAGAAATYTGTGGRMAWARRGCYATAGGK (SEQ ID NO: 10340) |
| 74 | TANYYATAGAAATYTGTGGRMAWARRGCYATAGGK (SEQ ID NO: 10341) |
| 74 | TAGAAATYTGTGGRMAWARRGCYATAGGK (SEQ ID NO: 10342) |
| 74 | GAAATYTGTGGRMAWARRGCYATAGGK (SEQ ID NO: 10343) |
| 74 | AAATYTGTGGRMAWARRGCYATAGGK (SEQ ID NO: 10344) |
| 74 | TYTGTGGRMAWARRGCYATAGGK (SEQ ID NO: 10345) |
| 74 | TATGAKSAVRTANHHRTAGARATYTGYGGRMAHARRRYYATAGGT (SEQ ID NO: 10346) |
| 74 | KSARRTANYYATAGAAATYTGTGGRMAWARRGCYATAGGK + N (SEQ ID NO: 10347) |
| 74 | TANYYATAGAAATYTGTGGRMAWARRGCYATAGGK + N (SEQ ID NO: 10348) |
| 74 | TAGAAATYTGTGGRMAWARRGCYATAGGK + N (SEQ ID NO: 10349) |
| 74 | GAAATYTGTGGRMAWARRGCYATAGGK + N (SEQ ID NO: 10350) |
| 74 | AAATYTGTGGRMAWARRGCYATAGGK + N (SEQ ID NO: 10351) |
| 74 | TYTGTGGRMAWARRGCYATAGGK + N (SEQ ID NO: 10352) |
| 74 | TATGAKSAVRTANHHRTAGARATYTGYGGRMAHARRRYYATAGGT + N (SEQ ID NO: 10353) |
| 76 | ANYYA + TA + G + AAATYTGTGGRMAWARRGCYATAGGKWCAGTR (SEQ ID NO: 10354) |
| 76 | ANYYA + TAG + AAA + TYTGTGGRMAWARRGCYATAGGKWCAGTR (SEQ ID NO: 10355) |
| 76 | ANYYA + TA + GAAA + TYTGTGGRMAWARRGCYATAGGKWCAGTR (SEQ ID NO: 10356) |
| 76 | +G + AAA + TYTGTGGRMAWARRGCYATAGGKWCAGTR (SEQ ID NO: 10357) |
| 76 | +GAAA + TYTGT + GGRMAWARRGCYATAGGKWCAGTR (SEQ ID NO: 10358) |
| 76 | +G + AAATYTGT + GGRMAWARRGCYATAGGKWCAGTR (SEQ ID NO: 10359) |
| 76 | +AAA + TYTGT + GGRMAWARRGCYATAGGKWCAGTR (SEQ ID NO: 10360) |
| 76 | +AAATYTGT + GGRMAWARRGCYATAG + GKWCAGTR (SEQ ID NO: 10361) |
| 76 | +AAA + TYTGTGGRMAWARRGCYATAG + GKWCAGTR (SEQ ID NO: 10362) |
| 76 | +TYTGT + GGRMAWARRGCYATAG + GKWCAGTR (SEQ ID NO: 10363) |
| 76 | +TYTGTGGRMAWARRGCYATAG + GKW + CAGTR (SEQ ID NO: 10364) |
| 76 | +TYTGT + GGRMAWARRGCYATAGGKW + CAGTR (SEQ ID NO: 10365) |
| 76 | +GGRMAWARRGCYATAG + GKW + CAGTR (SEQ ID NO: 10366) |
| 76 | +GGRMAWARRGCYATAGGKW + CAG + TR (SEQ ID NO: 10367) |
| 76 | +GGRMAWARRGCYATAG + GKWCAG + TR (SEQ ID NO: 10368) |
| 76 | ANYYATAGAAATYTGTGGRMAWARRGCYATAGGKWCAGTR (SEQ ID NO: 10369) |
| 76 | GAAATYTGTGGRMAWARRGCYATAGGKWCAGTR (SEQ ID NO: 10370) |
| 76 | AAATYTGTGGRMAWARRGCYATAGGKWCAGTR (SEQ ID NO: 10371) |
| 76 | TYTGTGGRMAWARRGCYATAGGKWCAGTR (SEQ ID NO: 10372) |
| 76 | GGRMAWARRGCYATAGGKWCAGTR (SEQ ID NO: 10373) |
| 76 | SAVRTANHHRTAGARATYTGYGGRMAHARRRYYRYAGGTACAGTA (SEQ ID NO: 10374) |

TABLE 8-continued

| Codon | |
|---|---|
| 76 | ANYYATAGAAATYTGTGGRMAWARRGCYATAGGKWCAGTR + N (SEQ ID NO: 10375) |
| 76 | GAAATYTGTGGRMAWARRGCYATAGGKWCAGTR + N (SEQ ID NO: 10376) |
| 76 | AAATYTGTGGRMAWARRGCYATAGGKWCAGTR + N (SEQ ID NO: 10377) |
| 76 | TYTGTGGRMAWARRGCYATAGGKWCAGTR + N (SEQ ID NO: 10378) |
| 76 | GGRMAWARRGCYATAGGKWCAGTR + N (SEQ ID NO: 10379) |
| 76 | SAVRTANHHRTAGARATYTGYGGRMAHARRRYYRYAGGTACAGTA + N (SEQ ID NO: 10380) |
| 82 | MAWARRGCYATAG + GKW + CAG + TRYTRRTGGRCCYACACCTR (SEQ ID NO: 10381) |
| 82 | MAWARRGCYATAG + GKWCAG + TRY + TRRTGGRCCYACACCTR (SEQ ID NO: 10382) |
| 82 | MAWARRGCYATAG + GKW + CAGTRY + TRRTGGRCCYACACCTR (SEQ ID NO: 10383) |
| 82 | +CAG + TRY + TRRTGGRCCYACACCTR (SEQ ID NO: 10384) |
| 82 | +CAGTRY + TRR + TGGRCCYACACCTR (SEQ ID NO: 10385) |
| 82 | +CAG + TRYTRR + TGGRCCYACACCTR (SEQ ID NO: 10386) |
| 82 | +TRY + TRR + TGGRCCYACACCTR (SEQ ID NO: 10387) |
| 82 | +TRYTRR + TR + GGRCCYACACCTR (SEQ ID NO: 10388) |
| 82 | +TRY + TRRTR + GGRCCYACACCTR (SEQ ID NO: 10389) |
| 82 | RMAWARRGCYATAG + GKW + CAG + TRYTRRTGGRCCYACACCT (SEQ ID NO: 10390) |
| 82 | RMAWARRGCYATAG + GKWCAG + TRY + TRRTGGRCCYACACCT (SEQ ID NO: 10391) |
| 82 | RMAWARRGCYATAG + GKW + CAGTRY + TRRTGGRCCYACACCT (SEQ ID NO: 10392) |
| 82 | +CAG + TRY + TRRTGGRCCYACACCT (SEQ ID NO: 10393) |
| 82 | +CAGTRY + TRR + TGGRCCYACACCT (SEQ ID NO: 10394) |
| 82 | +CAG + TRYTRR + TGGRCCYACACCT (SEQ ID NO: 10395) |
| 82 | MAWARRGCYATAGGKWCAGTRYTRRTGGRCCYACACCTR (SEQ ID NO: 10396) |
| 82 | CAGTRYTRRTGGRCCYACACCTR (SEQ ID NO: 10397) |
| 82 | TRYTRRTGGRCCYACACCTR (SEQ ID NO: 10398) |
| 82 | RMAWARRGCYATAGGKWCAGTRYTRRTGGRCCYACACCT (SEQ ID NO: 10399) |
| 82 | CAGTRYTRRTGGRCCYACACCT (SEQ ID NO: 10400) |
| 82 | TGYGGRMAHARRRYYRYAGGTACAGTRTTRRTAGGRCCYACACCT (SEQ ID NO: 10401) |
| 82 | MAWARRGCYATAGGKWCAGTRYTRRTGGRCCYACACCTR + N (SEQ ID NO: 10402) |
| 82 | CAGTRYTRRTGGRCCYACACCTR + N (SEQ ID NO: 10403) |
| 82 | TRYTRRTGGRCCYACACCTR + N (SEQ ID NO: 10404) |
| 82 | RMAWARRGCYATAGGKWCAGTRYTRRTGGRCCYACACCT + N (SEQ ID NO: 10405) |
| 82 | CAGTRYTRRTGGRCCYACACCT + N (SEQ ID NO: 10406) |
| 82 | TGYGGRMAHARRRYYRYAGGTACAGTRTTRRTAGGRCCYACACCT + N (SEQ ID NO: 10407) |
| 83 | WARRGCYATAG + GKW + CAG + TRYTRRTGGRCCYACACCTRTC (SEQ ID NO: 10408) |
| 83 | WARRGCYATAG + GKWCAG + TRY + TRRTGGRCCYACACCTRTC (SEQ ID NO: 10409) |
| 83 | WARRGCYATAG + GKW + CAGTRY + TRRTGGRCCYACACCTRTC (SEQ ID NO: 10410) |
| 83 | +CAG + TRY + TRRTGGRCCYACACCTRTC (SEQ ID NO: 10411) |
| 83 | +CAGTRY + TRR + TGGRCCYACACCTRTC (SEQ ID NO: 10412) |
| 83 | +CAG + TRYTRR + TGGRCCYACACCTRTC (SEQ ID NO: 10413) |

TABLE 8-continued

| Codon | |
|---|---|
| 83 | +TRY + TRR + TRGGRCCYACACCTRTC (SEQ ID NO: 10414) |
| 83 | +TRYTRR + TR + GGRCCYACACCTRTC (SEQ ID NO: 10415) |
| 83 | +TRY + TRRTR + GGRCCYACACCTRTC (SEQ ID NO: 10416) |
| 83 | WARRGCYATAGGKWCAGTRYTRRTGGRCCYACACCTRTC (SEQ ID NO: 10417) |
| 83 | CAGTRYTRRTGGRCCYACACCTRTC (SEQ ID NO: 10418) |
| 83 | TRYTRRTGGRCCYACACCTRTC (SEQ ID NO: 10419) |
| 83 | GGRMAHARRRYYRYAGGTACAGTRTTRRTAGGRCCYACACCTGTC (SEQ ID NO: 10420) |
| 83 | WARRGCYATAGGKWCAGTRYTRRTGGRCCYACACCTRTC + N (SEQ ID NO: 10421) |
| 83 | CAGTRYTRRTGGRCCYACACCTRTC + N (SEQ ID NO: 10422) |
| 83 | TRYTRRTGGRCCYACACCTRTC + N (SEQ ID NO: 10423) |
| 83 | GGRMAHARRRYYRYAGGTACAGTRTTRRTAGGRCCYACACCTGTC + N (SEQ ID NO: 10424) |
| 84 | RGCYATAG + GKW + CAG + TRYTRRTGGRCCYACACCTRTCAAC (SEQ ID NO: 10425) |
| 84 | RGCYATAG + GKWCAG + TRY + TRRTGGRCCYACACCTRTCAAC (SEQ ID NO: 10426) |
| 84 | RGCYATAG + GKW + CAGTRY + TRRTGGRCCYACACCTRTCAAC (SEQ ID NO: 10427) |
| 84 | +CAG + TRY + TRRTGGRCCYACACCTRTCAAC (SEQ ID NO: 10428) |
| 84 | +CAGTRY + TRR + TGGRCCYACACCTRTCAAC (SEQ ID NO: 10429) |
| 84 | +CAG + TRYTRR + TGGRCCYACACCTRTCAAC (SEQ ID NO: 10430) |
| 84 | +TRY + TRR + TGGRCCYACACCTRTCAAC (SEQ ID NO: 10431) |
| 84 | +TRYTRR + TR + GGRCCYACACCTRTCAAC (SEQ ID NO: 10432) |
| 84 | +TRY + TRRTR + GGRCCYACACCTRTCAAC (SEQ ID NO: 10433) |
| 84 | +TRR + TR + GGRCCYACACCTRTCAAC (SEQ ID NO: 10434) |
| 84 | +TRRTR + G + GRCCYACACCTRTCAAC (SEQ ID NO: 10435) |
| 84 | +TRR + TRG + GRCCYACACCTRTCAAC (SEQ ID NO: 10436) |
| 84 | RGCYATAGGKWCAGTRYTRRTGGRCCYACACCTRTCAAC (SEQ ID NO: 10437) |
| 84 | CAGTRYTRRTGGRCCYACACCTRTCAAC (SEQ ID NO: 10438) |
| 84 | TRYTRRTGGRCCYACACCTRTCAAC (SEQ ID NO: 10439) |
| 84 | TRRTGGRCCYACACCTRTCAAC (SEQ ID NO: 10440) |
| 84 | MAHARRRYYRYAGGTACAGTRTTRRTAGGRCCYACMCCTGTCAAC (SEQ ID NO: 10441) |
| 84 | RGCYATAGGKWCAGTRYTRRTGGRCCYACACCTRTCAAC + N (SEQ ID NO: 10442) |
| 84 | CAGTRYTRRTGGRCCYACACCTRTCAAC + N (SEQ ID NO: 10443) |
| 84 | TRYTRRTGGRCCYACACCTRTCAAC + N (SEQ ID NO: 10444) |
| 84 | TRRTGGRCCYACACCTRTCAAC + N (SEQ ID NO: 10445) |
| 84 | MAHARRRYYRYAGGTACAGTRTTRRTAGGRCCYACMCCTGTCAAC + N (SEQ ID NO: 10446) |
| 88 | G + TRY + TRR + TRGGRCCYACACCTRTCAACATAATTGGRMGRA (SEQ ID NO: 10447) |
| 88 | G + TRYTRR + TR + GGRCCYACACCTRTCAACATAATTGGRMGRA (SEQ ID NO: 10448) |
| 88 | G + TRY + TRRTR + GGRCCYACACCTRTCAACATAATTGGRMGRA (SEQ ID NO: 10449) |
| 88 | +TRR + TR + GGRCCYACACCTRTCAACATAATTGGRMGRA (SEQ ID NO: 10450) |
| 88 | +TRRTR + G + GRCCYACACCTRTCAACATAATTGGRMGRA (SEQ ID NO: 10451) |
| 88 | +TRR + TRG + GRCCYACACCTRTCAACATAATTGGRMGRA (SEQ ID NO: 10452) |

TABLE 8-continued

| Codon | |
|---|---|
| 88 | +TR + G + GRCCYACACCTRTCAACATAATTGGRMGRA (SEQ ID NO: 10453) |
| 88 | +TRG + GRC + CYACACCTRTCAACATAATTGGRMGRA (SEQ ID NO: 10454) |
| 88 | +TR + GGRC + CYACACCTRTCAACATAATTGGRMGRA (SEQ ID NO: 10455) |
| 88 | +G + GRC + CYACACCTRTCAACATAATTGGRMGRA (SEQ ID NO: 10456) |
| 88 | +GGRC + CY + ACACCTRTCAACATAATTGGRMGRA (SEQ ID NO: 10457) |
| 88 | +G + GRCCY + ACACCTRTCAACATAATTGGRMGRA (SEQ ID NO: 10458) |
| 88 | +GRC + CY + ACACCTRTCAACATAATTGGRMGRA (SEQ ID NO: 10459) |
| 88 | +GRCCY + A + CACCTRTCAACATAATTGGRMGRA (SEQ ID NO: 10460) |
| 88 | +GRC + CYA + CACCTRTCAACATAATTGGRMGRA (SEQ ID NO: 10461) |
| 88 | +CY + A + CACCTRTCAACATAATTGGRMGRA (SEQ ID NO: 10462) |
| 88 | +CYA + CA + CCTRTCAACATAATTGGRMGRA (SEQ ID NO: 10463) |
| 88 | +CY + ACA + CCTRTCAACATAATTGGRMGRA (SEQ ID NO: 10464) |
| 88 | GTRYTRRTRGGRCCYACACCTRTCAACATAATTGGRMGRA (SEQ ID NO: 10465) |
| 88 | TRRTRGGRCCYACACCTRTCAACATAATTGGRMGRA (SEQ ID NO: 10466) |
| 88 | TRGGRCCYACACCTRTCAACATAATTGGRMGRA (SEQ ID NO: 10467) |
| 88 | GGRCCYACACCTRTCAACATAATTGGRMGRA (SEQ ID NO: 10468) |
| 88 | GRCCYACACCTRTCAACATAATTGGRMGRA (SEQ ID NO: 10469) |
| 88 | CYACACCTRTCAACATAATTGGRMGRA (SEQ ID NO: 10470) |
| 88 | GGTACAGTRTTRRTAGGRCCYACMCCTRYCAACATAATTGGAAGA (SEQ ID NO: 10471) |
| 88 | GTRYTRRTRGGRCCYACACCTRTCAACATAATTGGRMGRA + N (SEQ ID NO: 10472) |
| 88 | TRRTRGGRCCYACACCTRTCAACATAATTGGRMGRA + N (SEQ ID NO: 10473) |
| 88 | TRGGRCCYACACCTRTCAACATAATTGGRMGRA + N (SEQ ID NO: 10474) |
| 88 | GGRCCYACACCTRTCAACATAATTGGRMGRA + N (SEQ ID NO: 10475) |
| 88 | GRCCYACACCTRTCAACATAATTGGRMGRA + N (SEQ ID NO: 10476) |
| 88 | CYACACCTRTCAACATAATTGGRMGRA + N (SEQ ID NO: 10477) |
| 88 | GGTACAGTRTTRRTAGGRCCYACMCCTRYCAACATAATTGGAAGA + N (SEQ ID NO: 10478) |
| 89 | RY + TRR + TR + GGRCCYACACCTRTCAACATAATTGGRMGRAAY (SEQ ID NO: 10479) |
| 89 | RY + TRRTR + G + GRCCYACACCTRTCAACATAATTGGRMGRAAY (SEQ ID NO: 10480) |
| 89 | RY + TRR + TRG + GRCCYACACCTRTCAACATAATTGGRMGRAAY (SEQ ID NO: 10481) |
| 89 | +TR + G + GRCCYACACCTRTCAACATAATTGGRMGRAAY (SEQ ID NO: 10482) |
| 89 | +TRG + GRC + CYACACCTRTCAACATAATTGGRMGRAAY (SEQ ID NO: 10483) |
| 89 | +TR + GGRC + CYACACCTRTCAACATAATTGGRMGRAAY (SEQ ID NO: 10484) |
| 89 | +G + GRC + CYACACCTRTCAACATAATTGGRMGRAAY (SEQ ID NO: 10485) |
| 89 | +GGRC + CY + ACACCTRTCAACATAATTGGRMGRAAY (SEQ ID NO: 10486) |
| 89 | +G + GRCCY + ACACCTRTCAACATAATTGGRMGRAAY (SEQ ID NO: 10487) |
| 89 | +GRC + CY + ACACCTRTCAACATAATTGGRMGRAAY (SEQ ID NO: 10488) |
| 89 | +GRCCY + A + CACCTRTCAACATAATTGGRMGRAAY (SEQ ID NO: 10489) |
| 89 | +GRC + CYA + CACCTRTCAACATAATTGGRMGRAAY (SEQ ID NO: 10490) |
| 89 | +CY + A + CACCTRTCAACATAATTGGRMGRAAY (SEQ ID NO: 10491) |

TABLE 8-continued

| Codon | |
|---|---|
| 89 | +CYA + CA + CCTRTCAACATAATTGGRMGRAAY (SEQ ID NO: 10492) |
| 89 | +CY + ACA + CCTRTCAACATAATTGGRMGRAAY (SEQ ID NO: 10493) |
| 89 | +A + CA + CCTRTCAACATAATTGGRMGRAAY (SEQ ID NO: 10494) |
| 89 | +ACA + C + CTRTCAACATAATTGGRMGRAAY (SEQ ID NO: 10495) |
| 89 | +A + CAC + CTRTCAACATAATTGGRMGRAAY (SEQ ID NO: 10496) |
| 89 | RYTRRTRGGRCCYACACCTRTCAACATAATTGGRMGRAAY (SEQ ID NO: 10497) |
| 89 | TRGGRCCYACACCTRTCAACATAATTGGRMGRAAY (SEQ ID NO: 10498) |
| 89 | GGRCCYACACCTRTCAACATAATTGGRMGRAAY (SEQ ID NO: 10499) |
| 89 | GRCCYACACCTRTCAACATAATTGGRMGRAAY (SEQ ID NO: 10500) |
| 89 | CYACACCTRTCAACATAATTGGRMGRAAY (SEQ ID NO: 10501) |
| 89 | ACACCTRTCAACATAATTGGRMGRAAY (SEQ ID NO: 10502) |
| 89 | ACAGTRTTRRTAGGRCCYACMCCTRYCAACATAATTGGAAGAAAT (SEQ ID NO: 10503) |
| 89 | RYTRRTRGGRCCYACACCTRTCAACATAATTGGRMGRAAY + N (SEQ ID NO: 10504) |
| 89 | TRGGRCCYACACCTRTCAACATAATTGGRMGRAAY + N (SEQ ID NO: 10505) |
| 89 | GGRCCYACACCTRTCAACATAATTGGRMGRAAY + N (SEQ ID NO: 10506) |
| 89 | GRCCYACACCTRTCAACATAATTGGRMGRAAY + N (SEQ ID NO: 10507) |
| 89 | CYACACCTRTCAACATAATTGGRMGRAAY + N (SEQ ID NO: 10508) |
| 89 | ACACCTRTCAACATAATTGGRMGRAAY + N (SEQ ID NO: 10509) |
| 89 | ACAGTRTTRRTAGGRCCYACMCCTRYCAACATAATTGGAAGAAAT + N (SEQ ID NO: 10510) |
| 90 | RR + TR + G + GRCCYACACCTRTCAACATAATTGGRMGRAAYHTG (SEQ ID NO: 10511) |
| 90 | RR + TRG + GRC + CYACACCTRTCAACATAATTGGRMGRAAYHTG (SEQ ID NO: 10512) |
| 90 | RR + TR + GGRC + CYACACCTRTCAACATAATTGGRMGRAAYHTG (SEQ ID NO: 10513) |
| 90 | +G + GRC + CYACACCTRTCAACATAATTGGRMGRAAYHTG (SEQ ID NO: 10514) |
| 90 | +GGRC + CY + ACACCTRTCAACATAATTGGRMGRAAYHTG (SEQ ID NO: 10515) |
| 90 | +G + GRCCY + ACACCTRTCAACATAATTGGRMGRAAYHTG (SEQ ID NO: 10516) |
| 90 | +GRC + CY + ACACCTRTCAACATAATTGGRMGRAAYHTG (SEQ ID NO: 10517) |
| 90 | +GRCCY + A + CACCTRTCAACATAATTGGRMGRAAYHTG (SEQ ID NO: 10518) |
| 90 | +GRC + CYA + CACCTRTCAACATAATTGGRMGRAAYHTG (SEQ ID NO: 10519) |
| 90 | +CY + A + CACCTRTCAACATAATTGGRMGRAAYHTG (SEQ ID NO: 10520) |
| 90 | +CYA + CA + CCTRTCAACATAATTGGRMGRAAYHTG (SEQ ID NO: 10521) |
| 90 | +CY + ACA + CCTRTCAACATAATTGGRMGRAAYHTG (SEQ ID NO: 10522) |
| 90 | +A + CA + CCTRTCAACATAATTGGRMGRAAYHTG (SEQ ID NO: 10523) |
| 90 | +ACA + C + CTRTCAACATAATTGGRMGRAAYHTG (SEQ ID NO: 10524) |
| 90 | +A + CAC + CTRTCAACATAATTGGRMGRAAYHTG (SEQ ID NO: 10525) |
| 90 | +CA + C + CTRTCAACATAATTGGRMGRAAYHTG (SEQ ID NO: 10526) |
| 90 | +CAC + CTRTC + AACATAATTGGRMGRAAYHTG (SEQ ID NO: 10527) |
| 90 | +CA + CCTRTC + AACATAATTGGRMGRAAYHTG (SEQ ID NO: 10528) |
| 90 | RRTRGGRCCYACACCTRTCAACATAATTGGRMGRAAYHTG (SEQ ID NO: 10529) |
| 90 | GGRCCYACACCTRTCAACATAATTGGRMGRAAYHTG (SEQ ID NO: 10530) |

TABLE 8-continued

| Codon | |
|---|---|
| 90 | GRCCYACACCTRTCAACATAATTGGRMGRAAYHTG (SEQ ID NO: 10531) |
| 90 | CYACACCTRTCAACATAATTGGRMGRAAYHTG (SEQ ID NO: 10532) |
| 90 | ACACCTRTCAACATAATTGGRMGRAAYHTG (SEQ ID NO: 10533) |
| 90 | CACCTRTCAACATAATTGGRMGRAAYHTG (SEQ ID NO: 10534) |
| 90 | GTRTTRRTAGGRCCYACMCCTRYCAACATAATTGGRMGAAATCTG (SEQ ID NO: 10535) |
| 90 | RRTRGGRCCYACACCTRTCAACATAATTGGRMGRAAYHTG + N (SEQ ID NO: 10536) |
| 90 | GGRCCYACACCTRTCAACATAATTGGRMGRAAYHTG + N (SEQ ID NO: 10537) |
| 90 | GRCCYACACCTRTCAACATAATTGGRMGRAAYHTG + N (SEQ ID NO: 10538) |
| 90 | CYACACCTRTCAACATAATTGGRMGRAAYHTG + N (SEQ ID NO: 10539) |
| 90 | ACACCTRTCAACATAATTGGRMGRAAYHTG + N (SEQ ID NO: 10540) |
| 90 | CACCTRTCAACATAATTGGRMGRAAYHTG + N (SEQ ID NO: 10541) |

| Reverse Primer (5' to 3') | |
|---|---|
| 90 | GTRTTRRTAGGRCCYACMCCTRYCAACATAATTGGRMGAAATCTG + N (SEQ ID NO: 10542) |
| 10 | TCCTGTRTCTAAKAGRGCYTCYHTYRDYTGBCCYYCTAYYYTTAYTGTGAC (SEQ ID NO: 10543) |
| 10 | TCCTGTRTCTAAKAGRGCYTCYHTYRDYTGBCCYYCTAYYYTTAYTGTGAC + N (SEQ ID NO: 10544) |
| 11 | TGCTCCTGTRTCTAAKAGRGCYTCYHTYRDYTGBCCYYCTAYYYTTATTGT (SEQ ID NO: 10545) |
| 11 | TGCTCCTGTRTCTAAKAGRGCYTCYHTYRDYTGBCCYYCTAYYYTTATTGT + N (SEQ ID NO: 10546) |
| 20 | MYYYATDTCTTCTAATACTGTATCATCTGCTCCTGTRTCTAAKAGAGCTTC (SEQ ID NO: 10547) |
| 20 | MYYYATDTCTTCTAATACTGTATCATCTGCTCCTGTRTCTAAKAGAGCTTC + N (SEQ ID NO: 10548) |
| 23 | YCCTGGYAAMYYYATDTCTTCTAATACTGTATCATCTGCTCCTGTATCTAA (SEQ ID NO: 10549) |
| 23 | YCCTGGYAAMYYYATDTCTTCTAATACTGTATCATCTGCTCCTGTATCTAA + N (SEQ ID NO: 10550) |
| 24 | TYTYCCTGGYAAMYYYATDTCTTCTAATACTGTATCATCTGCTCCTGTATC (SEQ ID NO: 10551) |
| 24 | TYTYCCTGGYAAMYYYATDTCTTCTAATACTGTATCATCTGCTCCTGTATC + N (SEQ ID NO: 10552) |
| 30 | TATYATTTTTGGYTTCCATYTYCCTGGYAAMYYYATDTCTTCTAATACTGT (SEQ ID NO: 10553) |
| 30 | TATYATTTTTGGYTTCCATYTYCCTGGYAAMYYYATDTCTTCTAATACTGT + N (SEQ ID NO: 10554) |
| 32 | TCCYCCTATYATTTTTGGYTTCCATYTYCCTGGYAAMYYYATDTCTTCTAA (SEQ ID NO: 10555) |
| 32 | TCCYCCTATYATTTTTGGYTTCCATYTYCCTGGYAAMYYYATDTCTTCTAA + N (SEQ ID NO: 10556) |
| 33 | AATTCCYCCTATYATTTTTGGYTTCCATYTYCCTGGYAAMYYYATTTCTTC (SEQ ID NO: 10557) |
| 33 | AATTCCYCCTATYATTTTTGGYTTCCATYTYCCTGGYAAMYYYATTTCTTC + N (SEQ ID NO: 10558) |
| 43 | MTCATAYTGYYTTACYTTRAYAAARCCTCCAATTCCYCCTATYATTTTTGG (SEQ ID NO: 10559) |
| 43 | MTCATAYTGYYTTACYTTRAYAAARCCTCCAATTCCYCCTATYATTTTTGG + N (SEQ ID NO: 10560) |
| 46 | DDNTAYBTSMTCATAYTGYYTTACYTTRAYAAARCCTCCAATTCCCCCTAT (SEQ ID NO: 10561) |
| 46 | DDNTAYBTSMTCATAYTGYYTTACYTTRAYAAARCCTCCAATTCCCCCTAT + N (SEQ ID NO: 10562) |
| 47 | +T + C + ATAYTGYYTTACYTTRATAAARCCTCCAATTCCYCCTA (SEQ ID NO: 10563) |

TABLE 8-continued

| Codon | |
|---|---|
| 47 | +TC + A + TAYTGYYTTACYTTRATAAARCCTCCAATTCCYCCTA (SEQ ID NO: 10564) |
| 47 | +T + CA + TAYTGYYTTACYTTRATAAARCCTCCAATTCCYCCTA (SEQ ID NO: 10565) |
| 47 | +C + A + TAYTGYYTTACYTTRATAAARCCTCCAATTCCYCCTA (SEQ ID NO: 10566) |
| 47 | +CA + TA + YTGYYTTACYTTRATAAARCCTCCAATTCCYCCTA (SEQ ID NO: 10567) |
| 47 | +C + ATA + YTGYYTTACYTTRATAAARCCTCCAATTCCYCCTA (SEQ ID NO: 10568) |
| 47 | +A + TA + YTGYYTTACYTTRATAAARCCTCCAATTCCYCCTA (SEQ ID NO: 10569) |
| 47 | +ATA + Y + TGYYTTACYTTRATAAARCCTCCAATTCCYCCTA (SEQ ID NO: 10570) |
| 47 | +A + TAY + TGYYTTACYTTRATAAARCCTCCAATTCCYCCTA (SEQ ID NO: 10571) |
| 47 | +TA + Y + TGYYTTACYTTRATAAARCCTCCAATTCCYCCTA (SEQ ID NO: 10572) |
| 47 | +TAY + TG + YYTTACYTTRATAAARCCTCCAATTCCYCCTA (SEQ ID NO: 10573) |
| 47 | +TA + YTG + YYTTACYTTRATAAARCCTCCAATTCCYCCTA (SEQ ID NO: 10574) |
| 47 | +Y + TG + YYTTACYTTRATAAARCCTCCAATTCCYCCTA (SEQ ID NO: 10575) |
| 47 | +YTG + Y + YTTACYTTRATAAARCCTCCAATTCCYCCTA (SEQ ID NO: 10576) |
| 47 | +Y + TGY + YTTACYTTRATAAARCCTCCAATTCCYCCTA (SEQ ID NO: 10577) |
| 47 | +TG + Y + YTTACYTTRATAAARCCTCCAATTCCYCCTA (SEQ ID NO: 10578) |
| 47 | +TGY + YT + TACYTTRATAAARCCTCCAATTCCYCCTA (SEQ ID NO: 10579) |
| 47 | +TG + YYT + TACYTTRATAAARCCTCCAATTCCYCCTA (SEQ ID NO: 10580) |
| 47 | TCATAYTGYYTTACYTTRATAAARCCTCCAATTCCYCCTA (SEQ ID NO: 10581) |
| 47 | CATAYTGYYTTACYTTRATAAARCCTCCAATTCCYCCTA (SEQ ID NO: 10582) |
| 47 | ATAYTGYYTTACYTTRATAAARCCTCCAATTCCYCCTA (SEQ ID NO: 10583) |
| 47 | TAYTGYYTTACYTTRATAAARCCTCCAATTCCYCCTA (SEQ ID NO: 10584) |
| 47 | YTGYYTTACYTTRATAAARCCTCCAATTCCYCCTA (SEQ ID NO: 10585) |
| 47 | TGYYTTACYTTRATAAARCCTCCAATTCCYCCTA (SEQ ID NO: 10586) |
| 47 | TAYDDNTAYBTSMTCATAYTGYYTTACYTTRAYAAARCCTCCAATTCCCCC (SEQ ID NO: 10587) |
| 47 | TCATAYTGYYTTACYTTRATAAARCCTCCAATTCCYCCTA + N (SEQ ID NO: 10588) |
| 47 | CATAYTGYYTTACYTTRATAAARCCTCCAATTCCYCCTA + N (SEQ ID NO: 10589) |
| 47 | ATAYTGYYTTACYTTRATAAARCCTCCAATTCCYCCTA + N (SEQ ID NO: 10590) |
| 47 | TAYTGYYTTACYTTRATAAARCCTCCAATTCCYCCTA + N (SEQ ID NO: 10591) |
| 47 | YTGYYTTACYTTRATAAARCCTCCAATTCCYCCTA + N (SEQ ID NO: 10592) |
| 47 | TGYYTTACYTTRATAAARCCTCCAATTCCYCCTA + N (SEQ ID NO: 10593) |
| 47 | TAYDDNTAYBTSMTCATAYTGYYTTACYTTRAYAAARCCTCCAATTCCCCC + N (SEQ ID NO: 10594) |
| 48 | YTCTAYDDNTAYBTSMTCATAYTGYYTTACYTTRAYAAARCCTCCAATTCC (SEQ ID NO: 10595) |
| 48 | YTCTAYDDNTAYBTSMTCATAYTGYYTTACYTTRAYAAARCCTCCAATTCC + N (SEQ ID NO: 10596) |
| 50 | +RB + T + AYYTSHTCATAYTGYYTTACYTTRATAAARCCTCCAA (SEQ ID NO: 10597) |
| 50 | RBT + AY + Y + TSHTCATAYTGYYTTACYTTRATAAARCCTCCAA (SEQ ID NO: 10598) |
| 50 | RB + T + AYY + TSHTCATAYTGYYTTACYTTRATAAARCCTCCAA (SEQ ID NO: 10599) |
| 50 | +T + AY + YTSHTCATAYTGYYTTACYTTRATAAARCCTCCAA (SEQ ID NO: 10600) |
| 50 | +TAY + Y + TSHTCATAYTGYYTTACYTTRATAAARCCTCCAA (SEQ ID NO: 10601) |

TABLE 8-continued

| Codon | |
|---|---|
| 50 | +T + AYY + TSHTCATAYTGYYTTACYTTRATAAARCCTCCAA (SEQ ID NO: 10602) |
| 50 | +AY + Y + TSHTCATAYTGYYTTACYTTRATAAARCCTCCAA (SEQ ID NO: 10603) |
| 50 | +AYY + TS + HTCATAYTGYYTTACYTTRATAAARCCTCCAA (SEQ ID NO: 10604) |
| 50 | +AY + YTS + HTCATAYTGYYTTACYTTRATAAARCCTCCAA (SEQ ID NO: 10605) |
| 50 | +Y + TS + HTCATAYTGYYTTACYTTRATAAARCCTCCAA (SEQ ID NO: 10606) |
| 50 | +YTS + H + TCATAYTGYYTTACYTTRATAAARCCTCCAA (SEQ ID NO: 10607) |
| 50 | +Y + TSH + TCATAYTGYYTTACYTTRATAAARCCTCCAA (SEQ ID NO: 10608) |
| 50 | +TS + H + TCATAYTGYYTTACYTTRATAAARCCTCCAA (SEQ ID NO: 10609) |
| 50 | +TSH + TCA + TAYTGYYTTACYTTRATAAARCCTCCAA (SEQ ID NO: 10610) |
| 50 | +TS + HTCA + TAYTGYYTTACYTTRATAAARCCTCCAA (SEQ ID NO: 10611) |
| 50 | +H + TCA + TAYTGYYTTACYTTRATAAARCCTCCAA (SEQ ID NO: 10612) |
| 50 | +HTCA + TA + YTGYYTTACYTTRATAAARCCTCCAA (SEQ ID NO: 10613) |
| 50 | +H + TCATA + YTGYYTTACYTTRATAAARCCTCCAA (SEQ ID NO: 10614) |
| 50 | RBTAYYTSHTCATAYTGYYTTACYTTRATAAARCCTCCAA (SEQ ID NO: 10615) |
| 50 | TAYYTSHTCATAYTGYYTTACYTTRATAAARCCTCCAA (SEQ ID NO: 10616) |
| 50 | AYYTSHTCATAYTGYYTTACYTTRATAAARCCTCCAA (SEQ ID NO: 10617) |
| 50 | YTSHTCATAYTGYYTTACYTTRATAAARCCTCCAA (SEQ ID NO: 10618) |
| 50 | TSHTCATAYTGYYTTACYTTRATAAARCCTCCAA (SEQ ID NO: 10619) |
| 50 | HTCATAYTGYYTTACYTTRATAAARCCTCCAA (SEQ ID NO: 10620) |
| 50 | RCARATYTCTAYDDNTAYBTSMTCATAYTGYYTTACYTTRAYAAAACCTCC (SEQ ID NO: 10621) |
| 50 | RBTAYYTSHTCATAYTGYYTTACYTTRATAAARCCTCCAA + N (SEQ ID NO: 10622) |
| 50 | TAYYTSHTCATAYTGYYTTACYTTRATAAARCCTCCAA + N (SEQ ID NO: 10623) |
| 50 | AYYTSHTCATAYTGYYTTACYTTRATAAARCCTCCAA + N (SEQ ID NO: 10624) |
| 50 | YTSHTCATAYTGYYTTACYTTRATAAARCCTCCAA + N (SEQ ID NO: 10625) |
| 50 | TSHTCATAYTGYYTTACYTTRATAAARCCTCCAA + N (SEQ ID NO: 10626) |
| 50 | HTCATAYTGYYTTACYTTRATAAARCCTCCAA + N (SEQ ID NO: 10627) |
| 50 | RCARATYTCTAYDDNTAYBTSMTCATAYTGYYTTACYTTRAYAAAACCTCC + N (SEQ ID NO: 10628) |
| 53 | A + RA + TTT + CTATRRBTAYYTSHTCATAYTGYYTTACYTTRAT (SEQ ID NO: 10629) |
| 53 | A + RATTT + C + TATRRBTAYYTSHTCATAYTGYYTTACYTTRAT (SEQ ID NO: 10630) |
| 53 | A + RA + TTTC + TATRRBTAYYTSHTCATAYTGYYTTACYTTRAT (SEQ ID NO: 10631) |
| 53 | +TTT + C + TATRRBTAYYTSHTCATAYTGYYTTACYTTRAT (SEQ ID NO: 10632) |
| 53 | +TTTC + TA + TRRBTAYYTSHTCATAYTGYYTTACYTTRAT (SEQ ID NO: 10633) |
| 53 | +TTT + CTA + TRRBTAYYTSHTCATAYTGYYTTACYTTRAT (SEQ ID NO: 10634) |
| 53 | +C + TA + TRRBTAYYTSHTCATAYTGYYTTACYTTRAT (SEQ ID NO: 10635) |
| 53 | +CTA + TRRB + TAYYTSHTCATAYTGYYTTACYTTRAT (SEQ ID NO: 10636) |
| 53 | +C + TATRRB + TAYYTSHTCATAYTGYYTTACYTTRAT (SEQ ID NO: 10637) |
| 53 | +TA + TRRB + TAYYTSHTCATAYTGYYTTACYTTRAT (SEQ ID NO: 10638) |
| 53 | +TATRRB + TA + YYTSHTCATAYTGYYTTACYTTRAT (SEQ ID NO: 10639) |

TABLE 8-continued

| Codon | |
|---|---|
| 53 | +TA + TRRBTA + YYTSHTCATAYTGYYTTACYTTRAT (SEQ ID NO: 10640) |
| 53 | +TRRB + TA + YYTSHTCATAYTGYYTTACYTTRAT (SEQ ID NO: 10641) |
| 53 | +TRRBTA + Y + YTSHTCATAYTGYYTTACYTTRAT (SEQ ID NO: 10642) |
| 53 | +TRRB + TAY + YTSHTCATAYTGYYTTACYTTRAT (SEQ ID NO: 10643) |
| 53 | +TA + Y + YTSHTCATAYTGYYTTACYTTRAT (SEQ ID NO: 10644) |
| 53 | +TAY + YTS + HTCATAYTGYYTTACYTTRAT (SEQ ID NO: 10645) |
| 53 | +TA + YYTS + HTCATAYTGYYTTACYTTRAT (SEQ ID NO: 10646) |
| 53 | RA + TT + TCT + ATRRBTAYYTSHTCATAYTGYYTTACYTTRATA (SEQ ID NO: 10647) |
| 53 | RA + TTTCT + A + TRRBTAYYTSHTCATAYTGYYTTACYTTRATA (SEQ ID NO: 10648) |
| 53 | RA + TT + TCTA + TRRBTAYYTSHTCATAYTGYYTTACYTTRATA (SEQ ID NO: 10649) |
| 53 | +TCT + A + TRRBTAYYTSHTCATAYTGYYTTACYTTRATA (SEQ ID NO: 10650) |
| 53 | +TCTA + TR + RBTAYYTSHTCATAYTGYYTTACYTTRATA (SEQ ID NO: 10651) |
| 53 | +TCT + ATR + RBTAYYTSHTCATAYTGYYTTACYTTRATA (SEQ ID NO: 10652) |
| 53 | +A + TR + RBTAYYTSHTCATAYTGYYTTACYTTRATA (SEQ ID NO: 10653) |
| 53 | +ATR + RBTA + YYTSHTCATAYTGYYTTACYTTRATA (SEQ ID NO: 10654) |
| 53 | +A + TRRBTA + YYTSHTCATAYTGYYTTACYTTRATA (SEQ ID NO: 10655) |
| 53 | +TR + RBTA + YYTSHTCATAYTGYYTTACYTTRATA (SEQ ID NO: 10656) |
| 53 | +TRRBTA + YY + TSHTCATAYTGYYTTACYTTRATA (SEQ ID NO: 10657) |
| 53 | +TR + RBTAYY + TSHTCATAYTGYYTTACYTTRATA (SEQ ID NO: 10658) |
| 53 | +RBTA + YY + TSHTCATAYTGYYTTACYTTRATA (SEQ ID NO: 10659) |
| 53 | +RBTAYY + T + SHTCATAYTGYYTTACYTTRATA (SEQ ID NO: 10660) |
| 53 | +RBTA + YYT + SHTCATAYTGYYTTACYTTRATA (SEQ ID NO: 10661) |
| 53 | +YY + T + SHTCATAYTGYYTTACYTTRATA (SEQ ID NO: 10662) |
| 53 | +YYT + SHT + CATAYTGYYTTACYTTRATA (SEQ ID NO: 10663) |
| 53 | +YY + TSHT + CATAYTGYYTTACYTTRATA (SEQ ID NO: 10664) |
| 53 | ARATTTCTATRRBTAYYTSHTCATAYTGYYTTACYTTRAT (SEQ ID NO: 10665) |
| 53 | TTTCTATRRBTAYYTSHTCATAYTGYYTTACYTTRAT (SEQ ID NO: 10666) |
| 53 | CTATRRBTAYYTSHTCATAYTGYYTTACYTTRAT (SEQ ID NO: 10667) |
| 53 | TATRRBTAYYTSHTCATAYTGYYTTACYTTRAT (SEQ ID NO: 10668) |
| 53 | TRRBTAYYTSHTCATAYTGYYTTACYTTRAT (SEQ ID NO: 10669) |
| 53 | TAYYTSHTCATAYTGYYTTACYTTRAT (SEQ ID NO: 10670) |
| 53 | RATTTCTATRRBTAYYTSHTCATAYTGYYTTACYTTRATA (SEQ ID NO: 10671) |
| 53 | TCTATRRBTAYYTSHTCATAYTGYYTTACYTTRATA (SEQ ID NO: 10672) |
| 53 | ATRRBTAYYTSHTCATAYTGYYTTACYTTRATA (SEQ ID NO: 10673) |
| 53 | TRRBTAYYTSHTCATAYTGYYTTACYTTRATA (SEQ ID NO: 10674) |
| 53 | RBTAYYTSHTCATAYTGYYTTACYTTRATA (SEQ ID NO: 10675) |
| 53 | YYTSHTCATAYTGYYTTACYTTRATA (SEQ ID NO: 10676) |
| 53 | YYTDTKYCCRCARATYTCTAYDDNTAYBTSMTCATAYTGYYTTACTTTGAT (SEQ ID NO: 10677) |
| 53 | ARATTTCTATRRBTAYYTSHTCATAYTGYYTTACYTTRAT + N (SEQ ID NO: 10678) |

TABLE 8-continued

| Codon | |
|---|---|
| 53 | TTTCTATRRBTAYYTSHTCATAYTGYYTTACYTTRAT + N (SEQ ID NO: 10679) |
| 53 | CTATRRBTAYYTSHTCATAYTGYYTTACYTTRAT + N (SEQ ID NO: 10680) |
| 53 | TATRRBTAYYTSHTCATAYTGYYTTACYTTRAT + N (SEQ ID NO: 10681) |
| 53 | TRRBTAYYTSHTCATAYTGYYTTACYTTRAT + N (SEQ ID NO: 10682) |
| 53 | TAYYTSHTCATAYTGYYTTACYTTRAT + N (SEQ ID NO: 10683) |
| 53 | RATTTCTATRRBTAYYTSHTCATAYTGYYTTACYTTRATA + N (SEQ ID NO: 10684) |
| 53 | TCTATRRBTAYYTSHTCATAYTGYYTTACYTTRATA + N (SEQ ID NO: 10685) |
| 53 | ATRRBTAYYTSHTCATAYTGYYTTACYTTRATA + N (SEQ ID NO: 10686) |
| 53 | TRRBTAYYTSHTCATAYTGYYTTACYTTRATA + N (SEQ ID NO: 10687) |
| 53 | RBTAYYTSHTCATAYTGYYTTACYTTRATA + N (SEQ ID NO: 10688) |
| 53 | YYTSHTCATAYTGYYTTACYTTRATA + N (SEQ ID NO: 10689) |
| 53 | YYTDTKYCCRCARATYTCTAYDDNTAYBTSMTCATAYTGYYTTACTTTGAT + N (SEQ ID NO: 10690) |
| 54 | +CAC + A + RATTTCTATRRBTAYYTSHTCATAYTGYYTTACYTT (SEQ ID NO: 10691) |
| 54 | +CACA + RA + TTTCTATRRBTAYYTSHTCATAYTGYYTTACYTT (SEQ ID NO: 10692) |
| 54 | +CAC + ARA + TTTCTATRRBTAYYTSHTCATAYTGYYTTACYTT (SEQ ID NO: 10693) |
| 54 | +A + RA + TTTCTATRRBTAYYTSHTCATAYTGYYTTACYTT (SEQ ID NO: 10694) |
| 54 | +ARA + TTTC + TATRRBTAYYTSHTCATAYTGYYTTACYTT (SEQ ID NO: 10695) |
| 54 | +A + RATTTC + TATRRBTAYYTSHTCATAYTGYYTTACYTT (SEQ ID NO: 10696) |
| 54 | +RA + TTTC + TATRRBTAYYTSHTCATAYTGYYTTACYTT (SEQ ID NO: 10697) |
| 54 | +RATTTC + TA + TRRBTAYYTSHTCATAYTGYYTTACYTT (SEQ ID NO: 10698) |
| 54 | +RA + TTTCTA + TRRBTAYYTSHTCATAYTGYYTTACYTT (SEQ ID NO: 10699) |
| 54 | +TTTC + TA + TRRBTAYYTSHTCATAYTGYYTTACYTT (SEQ ID NO: 10700) |
| 54 | +TTTCTA + T + RRBTAYYTSHTCATAYTGYYTTACYTT (SEQ ID NO: 10701) |
| 54 | +TTTC + TAT + RRBTAYYTSHTCATAYTGYYTTACYTT (SEQ ID NO: 10702) |
| 54 | +TA + T + RRBTAYYTSHTCATAYTGYYTTACYTT (SEQ ID NO: 10703) |
| 54 | +TAT + RRB + TAYYTSHTCATAYTGYYTTACYTT (SEQ ID NO: 10704) |
| 54 | +TA + TRRB + TAYYTSHTCATAYTGYYTTACYTT (SEQ ID NO: 10705) |
| 54 | +T + RRB + TAYYTSHTCATAYTGYYTTACYTT (SEQ ID NO: 10706) |
| 54 | +TRRB + TAY + YTSHTCATAYTGYYTTACYTT (SEQ ID NO: 10707) |
| 54 | +T + RRBTAY + YTSHTCATAYTGYYTTACYTT (SEQ ID NO: 10708) |
| 54 | A + CAR + A + TTTCTATRRBTAYYTSHTCATAYTGYYTTACYTTR (SEQ ID NO: 10709) |
| 54 | A + CARA + TT + TCTATRRBTAYYTSHTCATAYTGYYTTACYTTR (SEQ ID NO: 10710) |
| 54 | A + CAR + ATT + TCTATRRBTAYYTSHTCATAYTGYYTTACYTTR (SEQ ID NO: 10711) |
| 54 | +A + TT + TCTATRRBTAYYTSHTCATAYTGYYTTACYTTR (SEQ ID NO: 10712) |
| 54 | +ATT + TCTA + TRRBTAYYTSHTCATAYTGYYTTACYTTR (SEQ ID NO: 10713) |
| 54 | +A + TTTCTA + TRRBTAYYTSHTCATAYTGYYTTACYTTR (SEQ ID NO: 10714) |
| 54 | +TT + TCTA + TRRBTAYYTSHTCATAYTGYYTTACYTTR (SEQ ID NO: 10715) |
| 54 | +TTTCTA + TR + RBTAYYTSHTCATAYTGYYTTACYTTR (SEQ ID NO: 10716) |
| 54 | +TT + TCTATR + RBTAYYTSHTCATAYTGYYTTACYTTR (SEQ ID NO: 10717) |

TABLE 8-continued

| Codon | |
|---|---|
| 54 | +TCTA + TR + RBTAYYTSHTCATAYTGYYTTACYTTR (SEQ ID NO: 10718) |
| 54 | +TCTATR + R + BTAYYTSHTCATAYTGYYTTACYTTR (SEQ ID NO: 10719) |
| 54 | +TCTA + TRR + BTAYYTSHTCATAYTGYYTTACYTTR (SEQ ID NO: 10720) |
| 54 | +TR + R + BTAYYTSHTCATAYTGYYTTACYTTR (SEQ ID NO: 10721) |
| 54 | +TRR + BTA + YYTSHTCATAYTGYYTTACYTTR (SEQ ID NO: 10722) |
| 54 | +TR + RBTA + YYTSHTCATAYTGYYTTACYTTR (SEQ ID NO: 10723) |
| 54 | +R + BTA + YYTSHTCATAYTGYYTTACYTTR (SEQ ID NO: 10724) |
| 54 | +RBTA + YYT + SHTCATAYTGYYTTACYTTR (SEQ ID NO: 10725) |
| 54 | +R + BTAYYT + SHTCATAYTGYYTTACYTTR (SEQ ID NO: 10726) |
| 54 | +CA + RAT + TTCTATRRBTAYYTSHTCATAYTGYYTTACYTTRA (SEQ ID NO: 10727) |
| 54 | CARAT + T + TC + TATRRBTAYYTSHTCATAYTGYYTTACYTTRA (SEQ ID NO: 10728) |
| 54 | CA + RAT + TTC + TATRRBTAYYTSHTCATAYTGYYTTACYTTRA (SEQ ID NO: 10729) |
| 54 | +RAT + T + TCTATRRBTAYYTSHTCATAYTGYYTTACYTTRA (SEQ ID NO: 10730) |
| 54 | +RATT + TC + TATRRBTAYYTSHTCATAYTGYYTTACYTTRA (SEQ ID NO: 10731) |
| 54 | +RAT + TTC + TATRRBTAYYTSHTCATAYTGYYTTACYTTRA (SEQ ID NO: 10732) |
| 54 | +T + TC + TATRRBTAYYTSHTCATAYTGYYTTACYTTRA (SEQ ID NO: 10733) |
| 54 | +TTC + TATR + RBTAYYTSHTCATAYTGYYTTACYTTRA (SEQ ID NO: 10734) |
| 54 | +T + TCTATR + RBTAYYTSHTCATAYTGYYTTACYTTRA (SEQ ID NO: 10735) |
| 54 | +TC + TATR + RBTAYYTSHTCATAYTGYYTTACYTTRA (SEQ ID NO: 10736) |
| 54 | +TCTATR + RB + TAYYTSHTCATAYTGYYTTACYTTRA (SEQ ID NO: 10737) |
| 54 | +TC + TATRRB + TAYYTSHTCATAYTGYYTTACYTTRA (SEQ ID NO: 10738) |
| 54 | +TATR + RB + TAYYTSHTCATAYTGYYTTACYTTRA (SEQ ID NO: 10739) |
| 54 | +TATRRB + T + AYYTSHTCATAYTGYYTTACYTTRA (SEQ ID NO: 10740) |
| 54 | +TATR + RBT + AYYTSHTCATAYTGYYTTACYTTRA (SEQ ID NO: 10741) |
| 54 | +RB + T + AYYTSHTCATAYTGYYTTACYTTRA (SEQ ID NO: 10742) |
| 54 | +RBT + AYY + TSHTCATAYTGYYTTACYTTRA (SEQ ID NO: 10743) |
| 54 | +RB + TAYY + TSHTCATAYTGYYTTACYTTRA (SEQ ID NO: 10744) |
| 54 | CACARATTTCTATRRBTAYYTSHTCATAYTGYYTTACYTT (SEQ ID NO: 10745) |
| 54 | ARATTTCTATRRBTAYYTSHTCATAYTGYYTTACYTT (SEQ ID NO: 10746) |
| 54 | RATTTCTATRRBTAYYTSHTCATAYTGYYTTACYTT (SEQ ID NO: 10747) |
| 54 | TTTCTATRRBTAYYTSHTCATAYTGYYTTACYTT (SEQ ID NO: 10748) |
| 54 | TATRRBTAYYTSHTCATAYTGYYTTACYTT (SEQ ID NO: 10749) |
| 54 | TRRBTAYYTSHTCATAYTGYYTTACYTT (SEQ ID NO: 10750) |
| 54 | ACARATTTCTATRRBTAYYTSHTCATAYTGYYTTACYTTR (SEQ ID NO: 10751) |
| 54 | ATTTCTATRRBTAYYTSHTCATAYTGYYTTACYTTR (SEQ ID NO: 10752) |
| 54 | TTTCTATRRBTAYYTSHTCATAYTGYYTTACYTTR (SEQ ID NO: 10753) |
| 54 | TCTATRRBTAYYTSHTCATAYTGYYTTACYTTR (SEQ ID NO: 10754) |
| 54 | TRRBTAYYTSHTCATAYTGYYTTACYTTR (SEQ ID NO: 10755) |
| 54 | RBTAYYTSHTCATAYTGYYTTACYTTR (SEQ ID NO: 10756) |

TABLE 8-continued

| Codon | |
|---|---|
| 54 | CARATTTCTATRRBTAYYTSHTCATAYTGYYTTACYTTRA (SEQ ID NO: 10757) |
| 54 | RATTTCTATRRBTAYYTSHTCATAYTGYYTTACYTTRA (SEQ ID NO: 10758) |
| 54 | TTCTATRRBTAYYTSHTCATAYTGYYTTACYTTRA (SEQ ID NO: 10759) |
| 54 | TCTATRRBTAYYTSHTCATAYTGYYTTACYTTRA (SEQ ID NO: 10760) |
| 54 | TATRRBTAYYTSHTCATAYTGYYTTACYTTRA (SEQ ID NO: 10761) |
| 54 | RBTAYYTSHTCATAYTGYYTTACYTTRA (SEQ ID NO: 10762) |
| 54 | RRYYYTDTKYCCRCARATYTCTAYDDNTAYBTSMTCATAYTGYYTTACTTT (SEQ ID NO: 10763) |
| 54 | CACARATTTCTATRRBTAYYTSHTCATAYTGYYTTACYTT + N (SEQ ID NO: 10764) |
| 54 | ARATTTCTATRRBTAYYTSHTCATAYTGYYTTACYTT + N (SEQ ID NO: 10765) |
| 54 | RATTTCTATRRBTAYYTSHTCATAYTGYYTTACYTT + N (SEQ ID NO: 10766) |
| 54 | TTTCTATRRBTAYYTSHTCATAYTGYYTTACYTT + N (SEQ ID NO: 10767) |
| 54 | TATRRBTAYYTSHTCATAYTGYYTTACYTT + N (SEQ ID NO: 10768) |
| 54 | TRRBTAYYTSHTCATAYTGYYTTACYTT + N (SEQ ID NO: 10769) |
| 54 | ACARATTTCTATRRBTAYYTSHTCATAYTGYYTTACYTTR + N (SEQ ID NO: 10770) |
| 54 | ATTTCTATRRBTAYYTSHTCATAYTGYYTTACYTTR + N (SEQ ID NO: 10771) |
| 54 | TTTCTATRRBTAYYTSHTCATAYTGYYTTACYTTR + N (SEQ ID NO: 10772) |
| 54 | TCTATRRBTAYYTSHTCATAYTGYYTTACYTTR + N (SEQ ID NO: 10773) |
| 54 | TRRBTAYYTSHTCATAYTGYYTTACYTTR + N (SEQ ID NO: 10774) |
| 54 | RBTAYYTSHTCATAYTGYYTTACYTTR + N (SEQ ID NO: 10775) |
| 54 | CARATTTCTATRRBTAYYTSHTCATAYTGYYTTACYTTRA + N (SEQ ID NO: 10776) |
| 54 | RATTTCTATRRBTAYYTSHTCATAYTGYYTTACYTTRA + N (SEQ ID NO: 10777) |
| 54 | TTCTATRRBTAYYTSHTCATAYTGYYTTACYTTRA + N (SEQ ID NO: 10778) |
| 54 | TCTATRRBTAYYTSHTCATAYTGYYTTACYTTRA + N (SEQ ID NO: 10779) |
| 54 | TATRRBTAYYTSHTCATAYTGYYTTACYTTRA + N (SEQ ID NO: 10780) |
| 54 | RBTAYYTSHTCATAYTGYYTTACYTTRA + N (SEQ ID NO: 10781) |
| 54 | RRYYYTDTKYCCRCARATYTCTAYDDNTAYBTSMTCATAYTGYYTTACTTT + N(SEQ ID NO: 10782) |
| 58 | +GC + Y + YTWTKYCCACARATTTCTATRRBTAYYTSHTCATAYT (SEQ ID NO: 10783) |
| 58 | GCY + YTW + TKY + CCACARATTTCTATRRBTAYYTSHTCATAYT (SEQ ID NO: 10784) |
| 58 | GC + Y + YTWTKY + CCACARATTTCTATRRBTAYYTSHTCATAYT (SEQ ID NO: 10785) |
| 58 | +Y + YTW + TKYCCACARATTTCTATRRBTAYYTSHTCATAYT (SEQ ID NO: 10786) |
| 58 | +YYTW + TKY + CCACARATTTCTATRRBTAYYTSHTCATAYT (SEQ ID NO: 10787) |
| 58 | +Y + YTWTKY + CCACARATTTCTATRRBTAYYTSHTCATAYT (SEQ ID NO: 10788) |
| 58 | +YTW + TKY + CCACARATTTCTATRRBTAYYTSHTCATAYT (SEQ ID NO: 10789) |
| 58 | +YTWTKY + CCA + CARATTTCTATRRBTAYYTSHTCATAYT (SEQ ID NO: 10790) |
| 58 | +YTW + TKYCCA + CARATTTCTATRRBTAYYTSHTCATAYT (SEQ ID NO: 10791) |
| 58 | +TKY + CCA + CARATTTCTATRRBTAYYTSHTCATAYT (SEQ ID NO: 10792) |
| 58 | +TKYCCA + CARATT + TCTATRRBTAYYTSHTCATAYT (SEQ ID NO: 10793) |
| 58 | +TKY + CCACARATT + TCTATRRBTAYYTSHTCATAYT (SEQ ID NO: 10794) |
| 58 | +CCA + CARATT + TCTATRRBTAYYTSHTCATAYT (SEQ ID NO: 10795) |

TABLE 8-continued

| Codon | |
|---|---|
| 58 | +CCACARATT + TC + TATRRBTAYYTSHTCATAYT (SEQ ID NO: 10796) |
| 58 | +CCA + CARATTTC + TATRRBTAYYTSHTCATAYT (SEQ ID NO: 10797) |
| 58 | +CARATT + TC + TATRRBTAYYTSHTCATAYT (SEQ ID NO: 10798) |
| 58 | +CARATTTC + T + ATRRBTAYYTSHTCATAYT (SEQ ID NO: 10799) |
| 58 | +CARATT + TCT + ATRRBTAYYTSHTCATAYT (SEQ ID NO: 10800) |
| 58 | GCYYTWTKYCCACARATTTCTATRRBTAYYTSHTCATAYT (SEQ ID NO: 10801) |
| 58 | YYTWTKYCCACARATTTCTATRRBTAYYTSHTCATAYT (SEQ ID NO: 10802) |
| 58 | YTWTKYCCACARATTTCTATRRBTAYYTSHTCATAYT (SEQ ID NO: 10803) |
| 58 | TKYCCACARATTTCTATRRBTAYYTSHTCATAYT (SEQ ID NO: 10804) |
| 58 | CCACARATTTCTATRRBTAYYTSHTCATAYT (SEQ ID NO: 10805) |
| 58 | CARATTTCTATRRBTAYYTSHTCATAYT (SEQ ID NO: 10806) |
| 58 | ACTGTACCTRYRRYYYTDTKYCCRCARATYTCTAYDDNTAYBTSMTCATA (SEQ ID NO: 10807) |
| 58 | GCYYTWTKYCCACARATTTCTATRRBTAYYTSHTCATAYT + N (SEQ ID NO: 10808) |
| 58 | YYTWTKYCCACARATTTCTATRRBTAYYTSHTCATAYT + N (SEQ ID NO: 10809) |
| 58 | YTWTKYCCACARATTTCTATRRBTAYYTSHTCATAYT + N (SEQ ID NO: 10810) |
| 58 | TKYCCACARATTTCTATRRBTAYYTSHTCATAYT + N (SEQ ID NO: 10811) |
| 58 | CCACARATTTCTATRRBTAYYTSHTCATAYT + N (SEQ ID NO: 10812) |
| 58 | CARATTTCTATRRBTAYYTSHTCATAYT + N (SEQ ID NO: 10813) |
| 58 | ACTGTACCTRYRRYYYTDTKYCCRCARATYTCTAYDDNTAYBTSMTCATA + N (SEQ ID NO: 10814) |
| 71 | ATGTTG + AYA + GGT + GTRGGYCCYAYYARYACTGWACCTATRG (SEQ ID NO: 10815) |
| 71 | +ATGTTG + AYAGGT + GTRGGYCCYAYYARYACTGWACCTATRG (SEQ ID NO: 10816) |
| 71 | +ATGTTG + AYAGGT + GTRGGYCCYAYYARYACTGWACCTATRG (SEQ ID NO: 10817) |
| 71 | +GGT + GTR + GGYCCYAYYARYACTGWACCTATRG (SEQ ID NO: 10818) |
| 71 | +GGTGTR + GGY + CCYAYYARYACTGWACCTATRG (SEQ ID NO: 10819) |
| 71 | +GGT + GTRGGY + CCYAYYARYACTGWACCTATRG (SEQ ID NO: 10820) |
| 71 | +GTR + GGY + CCYAYYARYACTGWACCTATRG (SEQ ID NO: 10821) |
| 71 | +GTRGGY + CC + YAYYARYACTGWACCTATRG (SEQ ID NO: 10822) |
| 71 | +GTR + GGYCC + YAYYARYACTGWACCTATRG (SEQ ID NO: 10823) |
| 71 | +GGY + CC + YAYYARYACTGWACCTATRG (SEQ ID NO: 10824) |
| 71 | +GGYCC + Y + AYYARYACTGWACCTATRG (SEQ ID NO: 10825) |
| 71 | +GGY + CCY + AYYARYACTGWACCTATRG (SEQ ID NO: 10826) |
| 71 | +CC + Y + AYYARYACTGWACCTATRG (SEQ ID NO: 10827) |
| 71 | +CCY + AYY + ARYACTGWACCTATRG (SEQ ID NO: 10828) |
| 71 | +CC + YAYY + ARYACTGWACCTATRG (SEQ ID NO: 10829) |
| 71 | +Y + AYY + ARYACTGWACCTATRG (SEQ ID NO: 10830) |
| 71 | +YAYY + AR + YACTGWACCTATRG (SEQ ID NO: 10831) |
| 71 | +Y + AYYAR + YACTGWACCTATRG (SEQ ID NO: 10832) |
| 71 | ATGTTGAYAGGTGTRGGYCCYAYYARYACTGWACCTATRG (SEQ ID NO: 10833) |
| 71 | GGTGTRGGYCCYAYYARYACTGWACCTATRG (SEQ ID NO: 10834) |

TABLE 8-continued

| Codon | |
|---|---|
| 71 | GTRGGYCCYAYYARYACTGWACCTATRG (SEQ ID NO: 10835) |
| 71 | GGYCCYAYYARYACTGWACCTATRG (SEQ ID NO: 10836) |
| 71 | CCYAYYARYACTGWACCTATRG (SEQ ID NO: 10837) |
| 71 | YAYYARYACTGWACCTATRG (SEQ ID NO: 10838) |
| 71 | RTTYCKYCCAATTATGTTGRYAGGKGTRGGYCCTAYYAAYACTGTACCTAT (SEQ ID NO: 10839) |
| 71 | ATGTTGAYAGGTGTRGGYCCYAYYARYACTGWACCTATRG + N (SEQ ID NO: 10840) |
| 71 | GGTGTRGGYCCYAYYARYACTGWACCTATRG + N (SEQ ID NO: 10841) |
| 71 | GTRGGYCCYAYYARYACTGWACCTATRG + N (SEQ ID NO: 10842) |
| 71 | GGYCCYAYYARYACTGWACCTATRG + N (SEQ ID NO: 10843) |
| 71 | CCYAYYARYACTGWACCTATRG + N (SEQ ID NO: 10844) |
| 71 | YAYYARYACTGWACCTATRG + N (SEQ ID NO: 10845) |
| 71 | RTTYCKYCCAATTATGTTGRYAGGKGTRGGYCCTAYYAAYACTGTACCTAT + N(SEQ ID NO: 10846) |
| 73 | YC + CAA + TTA + TGTTGAYAGGTGTRGGYCCYAYYARYACTGWA (SEQ ID NO: 10847) |
| 73 | YC + CAATTA + TGT + TGAYAGGTGTRGGYCCYAYYARYACTGWA (SEQ ID NO: 10848) |
| 73 | YC + CAA + TTATGT + TGAYAGGTGTRGGYCCYAYYARYACTGWA (SEQ ID NO: 10849) |
| 73 | +TTA + TGT + TGAYAGGTGTRGGYCCYAYYARYACTGWA (SEQ ID NO: 10850) |
| 73 | +TTATGT + TG + AYAGGTGTRGGYCCYAYYARYACTGWA (SEQ ID NO: 10851) |
| 73 | +TTA + TGTTG + AYAGGTGTRGGYCCYAYYARYACTGWA (SEQ ID NO: 10852) |
| 73 | +TGT + TG + AYAGGTGTRGGYCCYAYYARYACTGWA (SEQ ID NO: 10853) |
| 73 | +TGTTG + A + YAGGTGTRGGYCCYAYYARYACTGWA (SEQ ID NO: 10854) |
| 73 | +TGT + TGA + YAGGTGTRGGYCCYAYYARYACTGWA (SEQ ID NO: 10855) |
| 73 | +TG + A + YAGGTGTRGGYCCYAYYARYACTGWA (SEQ ID NO: 10856) |
| 73 | +TGA + YAG + GTGTRGGYCCYAYYARYACTGWA (SEQ ID NO: 10857) |
| 73 | +TG + AYAG + GTGTRGGYCCYAYYARYACTGWA (SEQ ID NO: 10858) |
| 73 | +A + YAG + GTGTRGGYCCYAYYARYACTGWA (SEQ ID NO: 10859) |
| 73 | +AYAG + GT + GTRGGYCCYAYYARYACTGWA (SEQ ID NO: 10860) |
| 73 | +A + YAGGT + GTRGGYCCYAYYARYACTGWA (SEQ ID NO: 10861) |
| 73 | +YAG + GT + GTRGGYCCYAYYARYACTGWA (SEQ ID NO: 10862) |
| 73 | +YAGGT + G + TRGGYCCYAYYARYACTGWA (SEQ ID NO: 10863) |
| 73 | +YAG + GTG + TRGGYCCYAYYARYACTGWA (SEQ ID NO: 10864) |
| 73 | +CCA + ATT + ATGTTGAYAGGTGTRGGYCCYAYYARYACTGWAC (SEQ ID NO: 10865) |
| 73 | +CCAATT + ATG + TTGAYAGGTGTRGGYCCYAYYARYACTGWAC (SEQ ID NO: 10866) |
| 73 | +CCA + ATTATG + TTGAYAGGTGTRGGYCCYAYYARYACTGWAC (SEQ ID NO: 10867) |
| 73 | +ATT + ATG + TTGAYAGGTGTRGGYCCYAYYARYACTGWAC (SEQ ID NO: 10868) |
| 73 | +ATTATG + TTG + AYAGGTGTRGGYCCYAYYARYACTGWAC (SEQ ID NO: 10869) |
| 73 | +ATT + ATGTTG + AYAGGTGTRGGYCCYAYYARYACTGWAC (SEQ ID NO: 10870) |
| 73 | +ATG + TTG + AYAGGTGTRGGYCCYAYYARYACTGWAC (SEQ ID NO: 10871) |
| 73 | +ATGTTG + AY + AGGTGTRGGYCCYAYYARYACTGWAC (SEQ ID NO: 10872) |
| 73 | +ATG + TTGAY + AGGTGTRGGYCCYAYYARYACTGWAC (SEQ ID NO: 10873) |

TABLE 8-continued

| Codon | |
|---|---|
| 73 | +TTG + AY + AGGTGTRGGYCCYAYYARYACTGWAC (SEQ ID NO: 10874) |
| 73 | +TTGAY + A + GGTGTRGGYCCYAYYARYACTGWAC (SEQ ID NO: 10875) |
| 73 | +TTG + AYA + GGTGTRGGYCCYAYYARYACTGWAC (SEQ ID NO: 10876) |
| 73 | +AY + A + GGTGTRGGYCCYAYYARYACTGWAC (SEQ ID NO: 10877) |
| 73 | +AYA + GGT + GTRGGYCCYAYYARYACTGWAC (SEQ ID NO: 10878) |
| 73 | +AY + AGGT + GTRGGYCCYAYYARYACTGWAC (SEQ ID NO: 10879) |
| 73 | +A + GGT + GTRGGYCCYAYYARYACTGWAC (SEQ ID NO: 10880) |
| 73 | +AGGT + GT + RGGYCCYAYYARYACTGWAC (SEQ ID NO: 10881) |
| 73 | +A + GGTGT + RGGYCCYAYYARYACTGWAC (SEQ ID NO: 10882) |
| 73 | YCCAATTATGTTGAYAGGTGTRGGYCCYAYYARYACTGWA (SEQ ID NO: 10883) |
| 73 | TTATGTTGAYAGGTGTRGGYCCYAYYARYACTGWA (SEQ ID NO: 10884) |
| 73 | TGTTGAYAGGTGTRGGYCCYAYYARYACTGWA (SEQ ID NO: 10885) |
| 73 | TGAYAGGTGTRGGYCCYAYYARYACTGWA (SEQ ID NO: 10886) |
| 73 | AYAGGTGTRGGYCCYAYYARYACTGWA (SEQ ID NO: 10887) |
| 73 | YAGGTGTRGGYCCYAYYARYACTGWA (SEQ ID NO: 10888) |
| 73 | CCAATTATGTTGAYAGGTGTRGGYCCYAYYARYACTGWAC (SEQ ID NO: 10889) |
| 73 | ATTATGTTGAYAGGTGTRGGYCCYAYYARYACTGWAC (SEQ ID NO: 10890) |
| 73 | ATGTTGAYAGGTGTRGGYCCYAYYARYACTGWAC (SEQ ID NO: 10891) |
| 73 | TTGAYAGGTGTRGGYCCYAYYARYACTGWAC (SEQ ID NO: 10892) |
| 73 | AYAGGTGTRGGYCCYAYYARYACTGWAC (SEQ ID NO: 10893) |
| 73 | AGGTGTRGGYCCYAYYARYACTGWAC (SEQ ID NO: 10894) |
| 73 | CAWCADRTTYCKYCCAATTATGTTGRYAGGKGTRGGYCCTAYYAATACTGT (SEQ ID NO: 10895) |
| 73 | YCCAATTATGTTGAYAGGTGTRGGYCCYAYYARYACTGWA + N (SEQ ID NO: 10896) |
| 73 | TTATGTTGAYAGGTGTRGGYCCYAYYARYACTGWA + N (SEQ ID NO: 10897) |
| 73 | TGTTGAYAGGTGTRGGYCCYAYYARYACTGWA + N (SEQ ID NO: 10898) |
| 73 | TGAYAGGTGTRGGYCCYAYYARYACTGWA + N (SEQ ID NO: 10899) |
| 73 | AYAGGTGTRGGYCCYAYYARYACTGWA + N (SEQ ID NO: 10900) |
| 73 | YAGGTGTRGGYCCYAYYARYACTGWA + N (SEQ ID NO: 10901) |
| 73 | CCAATTATGTTGAYAGGTGTRGGYCCYAYYARYACTGWAC + N (SEQ ID NO: 10902) |
| 73 | ATTATGTTGAYAGGTGTRGGYCCYAYYARYACTGWAC + N (SEQ ID NO: 10903) |
| 73 | ATGTTGAYAGGTGTRGGYCCYAYYARYACTGWAC + N (SEQ ID NO: 10904) |
| 73 | TTGAYAGGTGTRGGYCCYAYYARYACTGWAC + N (SEQ ID NO: 10905) |
| 73 | AYAGGTGTRGGYCCYAYYARYACTGWAC + N (SEQ ID NO: 10906) |
| 73 | AGGTGTRGGYCCYAYYARYACTGWAC + N (SEQ ID NO: 10907) |
| 73 | CAWCADRTTYCKYCCAATTATGTTGRYAGGKGTRGGYCCTAYYAATACTGT + N (SEQ ID NO: 10908) |
| 74 | +CKY + CCA + ATTATGTTGAYAGGTGTRGGYCCYAYYARYACTG (SEQ ID NO: 10909) |
| 74 | +CKYCCA + ATT + ATGTTGAYAGGTGTRGGYCCYAYYARYACTG (SEQ ID NO: 10910) |
| 74 | +CKY + CCAATT + ATGTTGAYAGGTGTRGGYCCYAYYARYACTG (SEQ ID NO: 10911) |

TABLE 8-continued

| Codon | |
|---|---|
| 74 | +CCA + ATT + ATGTTGAYAGGTGTRGGYCCYAYYARYACTG (SEQ ID NO: 10912) |
| 74 | +CCAATT + AT + GTTGAYAGGTGTRGGYCCYAYYARYACTG (SEQ ID NO: 10913) |
| 74 | +CCA + ATTAT + GTTGAYAGGTGTRGGYCCYAYYARYACTG (SEQ ID NO: 10914) |
| 74 | +ATT + AT + GTTGAYAGGTGTRGGYCCYAYYARYACTG (SEQ ID NO: 10915) |
| 74 | +ATTAT + G + TTGAYAGGTGTRGGYCCYAYYARYACTG (SEQ ID NO: 10916) |
| 74 | +ATT + ATG + TTGAYAGGTGTRGGYCCYAYYARYACTG (SEQ ID NO: 10917) |
| 74 | +AT + G + TTGAYAGGTGTRGGYCCYAYYARYACTG (SEQ ID NO: 10918) |
| 74 | +ATG + TTG + AYAGGTGTRGGYCCYAYYARYACTG (SEQ ID NO: 10919) |
| 74 | +AT + GTTG + AYAGGTGTRGGYCCYAYYARYACTG (SEQ ID NO: 10920) |
| 74 | +G + TTG + AYAGGTGTRGGYCCYAYYARYACTG (SEQ ID NO: 10921) |
| 74 | +GTTG + AY + AGGTGTRGGYCCYAYYARYACTG (SEQ ID NO: 10922) |
| 74 | +G + TTGAY + AGGTGTRGGYCCYAYYARYACTG (SEQ ID NO: 10923) |
| 74 | +TTG + AY + AGGTGTRGGYCCYAYYARYACTG (SEQ ID NO: 10924) |
| 74 | +TTGAY + A + GGTGTRGGYCCYAYYARYACTG (SEQ ID NO: 10925) |
| 74 | +TTG + AYA + GGTGTRGGYCCYAYYARYACTG (SEQ ID NO: 10926) |
| 74 | CKYCCAATTATGTTGAYAGGTGTRGGYCCYAYYARYACTG (SEQ ID NO: 10927) |
| 74 | CCAATTATGTTGAYAGGTGTRGGYCCYAYYARYACTG (SEQ ID NO: 10928) |
| 74 | ATTATGTTGAYAGGTGTRGGYCCYAYYARYACTG (SEQ ID NO: 10929) |
| 74 | ATGTTGAYAGGTGTRGGYCCYAYYARYACTG (SEQ ID NO: 10930) |
| 74 | GTTGAYAGGTGTRGGYCCYAYYARYACTG (SEQ ID NO: 10931) |
| 74 | TTGAYAGGTGTRGGYCCYAYYARYACTG (SEQ ID NO: 10932) |
| 74 | RGTCAWCADRTTYCKYCCAATTATGTTGRYAGGKGTRGGYCCTAYTAATAC (SEQ ID NO: 10933) |
| 74 | CKYCCAATTATGTTGAYAGGTGTRGGYCCYAYYARYACTG + N (SEQ ID NO: 10934) |
| 74 | CCAATTATGTTGAYAGGTGTRGGYCCYAYYARYACTG + N (SEQ ID NO: 10935) |
| 74 | ATTATGTTGAYAGGTGTRGGYCCYAYYARYACTG + N (SEQ ID NO: 10936) |
| 74 | ATGTTGAYAGGTGTRGGYCCYAYYARYACTG + N (SEQ ID NO: 10937) |
| 74 | GTTGAYAGGTGTRGGYCCYAYYARYACTG + N (SEQ ID NO: 10938) |
| 74 | TTGAYAGGTGTRGGYCCYAYYARYACTG + N (SEQ ID NO: 10939) |
| 74 | RGTCAWCADRTTYCKYCCAATTATGTTGRYAGGKGTRGGYCCTAYTAATAC + N (SEQ ID NO: 10940) |
| 76 | +ADR + TT + YCKYCCAATTATGTTGAYAGGTGTRGGYCCYAYYA (SEQ ID NO: 10941) |
| 76 | +ADRTT + Y + CKYCCAATTATGTTGAYAGGTGTRGGYCCYAYYA (SEQ ID NO: 10942) |
| 76 | +ADR + TTY + CKYCCAATTATGTTGAYAGGTGTRGGYCCYAYYA (SEQ ID NO: 10943) |
| 76 | +TT + Y + CKYCCAATTATGTTGAYAGGTGTRGGYCCYAYYA (SEQ ID NO: 10944) |
| 76 | +TTY + CKY + CCAATTATGTTGAYAGGTGTRGGYCCYAYYA (SEQ ID NO: 10945) |
| 76 | +TT + YCKY + CCAATTATGTTGAYAGGTGTRGGYCCYAYYA (SEQ ID NO: 10946) |
| 76 | +Y + CKY + CCAATTATGTTGAYAGGTGTRGGYCCYAYYA (SEQ ID NO: 10947) |
| 76 | +YCKY + CC + AATTATGTTGAYAGGTGTRGGYCCYAYYA (SEQ ID NO: 10948) |
| 76 | +Y + CKYCC + AATTATGTTGAYAGGTGTRGGYCCYAYYA (SEQ ID NO: 10949) |
| 76 | +CKY + CC + AATTATGTTGAYAGGTGTRGGYCCYAYYA (SEQ ID NO: 10950) |

TABLE 8-continued

| Codon | |
|---|---|
| 76 | +CKYCC + A + ATTATGTTGAYAGGTGTRGGYCCYAYYA (SEQ ID NO: 10951) |
| 76 | +CKY + CCA + ATTATGTTGAYAGGTGTRGGYCCYAYYA (SEQ ID NO: 10952) |
| 76 | +CC + A + ATTATGTTGAYAGGTGTRGGYCCYAYYA (SEQ ID NO: 10953) |
| 76 | +CCA + AT + TATGTTGAYAGGTGTRGGYCCYAYYA (SEQ ID NO: 10954) |
| 76 | +CC + AAT + TATGTTGAYAGGTGTRGGYCCYAYYA (SEQ ID NO: 10955) |
| 76 | +A + AT + TATGTTGAYAGGTGTRGGYCCYAYYA (SEQ ID NO: 10956) |
| 76 | +AAT + T + ATGTTGAYAGGTGTRGGYCCYAYYA (SEQ ID NO: 10957) |
| 76 | +A + ATT + ATGTTGAYAGGTGTRGGYCCYAYYA (SEQ ID NO: 10958) |
| 76 | ADRTTYCKYCCAATTATGTTGAYAGGTGTRGGYCCYAYYA (SEQ ID NO: 10959) |
| 76 | TTYCKYCCAATTATGTTGAYAGGTGTRGGYCCYAYYA (SEQ ID NO: 10960) |
| 76 | YCKYCCAATTATGTTGAYAGGTGTRGGYCCYAYYA (SEQ ID NO: 10961) |
| 76 | CKYCCAATTATGTTGAYAGGTGTRGGYCCYAYYA (SEQ ID NO: 10962) |
| 76 | CCAATTATGTTGAYAGGTGTRGGYCCYAYYA (SEQ ID NO: 10963) |
| 76 | AATTATGTTGAYAGGTGTRGGYCCYAYYA (SEQ ID NO: 10964) |
| 76 | AAKYTGRGTCAWCADRTTYCKYCCAATTATGTTGRYAGGKGTRGGTCCTAC (SEQ ID NO: 10965) |
| 76 | ADRTTYCKYCCAATTATGTTGAYAGGTGTRGGYCCYAYYA + N (SEQ ID NO: 10966) |
| 76 | TTYCKYCCAATTATGTTGAYAGGTGTRGGYCCYAYYA + N (SEQ ID NO: 10967) |
| 76 | YCKYCCAATTATGTTGAYAGGTGTRGGYCCYAYYA + N (SEQ ID NO: 10968) |
| 76 | CKYCCAATTATGTTGAYAGGTGTRGGYCCYAYYA + N (SEQ ID NO: 10969) |
| 76 | CCAATTATGTTGAYAGGTGTRGGYCCYAYYA + N (SEQ ID NO: 10970) |
| 76 | AATTATGTTGAYAGGTGTRGGYCCYAYYA + N (SEQ ID NO: 10971) |
| 76 | AAKYTGRGTCAWCADRTTYCKYCCAATTATGTTGRYAGGKGTRGGTCCTAC + N (SEQ ID NO: 10972) |
| 82 | R + C + ADC + CAAKYTGRGTCAACADRTTYCKYCCAATTATGTTG (SEQ ID NO: 10973) |
| 82 | R + CADC + CAA + KYTGRGTCAACADRTTYCKYCCAATTATGTTG (SEQ ID NO: 10974) |
| 82 | R + C + ADCCAA + KYTGRGTCAACADRTTYCKYCCAATTATGTTG (SEQ ID NO: 10975) |
| 82 | +ADC + CAA + KYTGRGTCAACADRTTYCKYCCAATTATGTTG (SEQ ID NO: 10976) |
| 82 | +ADCCAA + KY + TGRGTCAACADRTTYCKYCCAATTATGTTG (SEQ ID NO: 10977) |
| 82 | +ADC + CAAKY + TGRGTCAACADRTTYCKYCCAATTATGTTG (SEQ ID NO: 10978) |
| 82 | +CAA + KY + TGRGTCAACADRTTYCKYCCAATTATGTTG (SEQ ID NO: 10979) |
| 82 | +CAAKY + T + GRGTCAACADRTTYCKYCCAATTATGTTG (SEQ ID NO: 10980) |
| 82 | +CAA + KYT + GRGTCAACADRTTYCKYCCAATTATGTTG (SEQ ID NO: 10981) |
| 82 | +KY + T + GRGTCAACADRTTYCKYCCAATTATGTTG (SEQ ID NO: 10982) |
| 82 | +KYT + GRG + TCAACADRTTYCKYCCAATTATGTTG (SEQ ID NO: 10983) |
| 82 | +KY + TGRG + TCAACADRTTYCKYCCAATTATGTTG (SEQ ID NO: 10984) |
| 82 | +T + GRG + TCAACADRTTYCKYCCAATTATGTTG (SEQ ID NO: 10985) |
| 82 | +TGRG + TCA + ACADRTTYCKYCCAATTATGTTG (SEQ ID NO: 10986) |
| 82 | +T + GRGTCA + ACADRTTYCKYCCAATTATGTTG (SEQ ID NO: 10987) |
| 82 | +GRG + TCA + ACADRTTYCKYCCAATTATGTTG (SEQ ID NO: 10988) |

TABLE 8-continued

| Codon | |
|---|---|
| 82 | +GRGTCA + ACA + DRTTYCKYCCAATTATGTTG (SEQ ID NO: 10989) |
| 82 | +GRG + TCAACA + DRTTYCKYCCAATTATGTTG (SEQ ID NO: 10990) |
| 82 | CA + D + CCA + AKYTGRGTCAACADRTTYCKYCCAATTATGTTGA (SEQ ID NO: 10991) |
| 82 | +CA + DCCA + AKYTGRGTCAACADRTTYCKYCCAATTATGTTGA (SEQ ID NO: 10992) |
| 82 | +CA + DCCA + AKYTGRGTCAACADRTTYCKYCCAATTATGTTGA (SEQ ID NO: 10993) |
| 82 | +CCA + AKY + TGRGTCAACADRTTYCKYCCAATTATGTTGA (SEQ ID NO: 10994) |
| 82 | +CCAAKY + TG + RGTCAACADRTTYCKYCCAATTATGTTGA (SEQ ID NO: 10995) |
| 82 | +CCA + AKYTG + RGTCAACADRTTYCKYCCAATTATGTTGA (SEQ ID NO: 10996) |
| 82 | +AKY + TG + RGTCAACADRTTYCKYCCAATTATGTTGA (SEQ ID NO: 10997) |
| 82 | +AKYTG + R + GTCAACADRTTYCKYCCAATTATGTTGA (SEQ ID NO: 10998) |
| 82 | +AKY + TGR + GTCAACADRTTYCKYCCAATTATGTTGA (SEQ ID NO: 10999) |
| 82 | +TG + R + GTCAACADRTTYCKYCCAATTATGTTGA (SEQ ID NO: 11000) |
| 82 | +TGR + GTC + AACADRTTYCKYCCAATTATGTTGA (SEQ ID NO: 11001) |
| 82 | +TG + RGTC + AACADRTTYCKYCCAATTATGTTGA (SEQ ID NO: 11002) |
| 82 | +R + GTC + AACADRTTYCKYCCAATTATGTTGA (SEQ ID NO: 11003) |
| 82 | +RGTC + AAC + ADRTTYCKYCCAATTATGTTGA (SEQ ID NO: 11004) |
| 82 | +R + GTCAAC + ADRTTYCKYCCAATTATGTTGA (SEQ ID NO: 11005) |
| 82 | +GTC + AAC + ADRTTYCKYCCAATTATGTTGA (SEQ ID NO: 11006) |
| 82 | +GTCAAC + ADR + TTYCKYCCAATTATGTTGA (SEQ ID NO: 11007) |
| 82 | +GTC + AACADR + TTYCKYCCAATTATGTTGA (SEQ ID NO: 11008) |
| 82 | RCADCCAAKYTGRGTCAACADRTTYCKYCCAATTATGTTG (SEQ ID NO: 11009) |
| 82 | ADCCAAKYTGRGTCAACADRTTYCKYCCAATTATGTTG (SEQ ID NO: 11010) |
| 82 | CAAKYTGRGTCAACADRTTYCKYCCAATTATGTTG (SEQ ID NO: 11011) |
| 82 | KYTGRGTCAACADRTTYCKYCCAATTATGTTG (SEQ ID NO: 11012) |
| 82 | TGRGTCAACADRTTYCKYCCAATTATGTTG (SEQ ID NO: 11013) |
| 82 | GRGTCAACADRTTYCKYCCAATTATGTTG (SEQ ID NO: 11014) |
| 82 | CADCCAAKYTGRGTCAACADRTTYCKYCCAATTATGTTGA (SEQ ID NO: 11015) |
| 82 | CCAAKYTGRGTCAACADRTTYCKYCCAATTATGTTGA (SEQ ID NO: 11016) |
| 82 | AKYTGRGTCAACADRTTYCKYCCAATTATGTTGA (SEQ ID NO: 11017) |
| 82 | TGRGTCAACADRTTYCKYCCAATTATGTTGA (SEQ ID NO: 11018) |
| 82 | RGTCAACADRTTYCKYCCAATTATGTTGA (SEQ ID NO: 11019) |
| 82 | GTCAACADRTTYCKYCCAATTATGTTGA (SEQ ID NO: 11020) |
| 82 | RAAATTTARWGTRCANCCAAKYTGRGTCAWCADRTTYCKYCCAATTATGTT (SEQ ID NO: 11021) |
| 82 | RCADCCAAKYTGRGTCAACADRTTYCKYCCAATTATGTTG + N (SEQ ID NO: 11022) |
| 82 | ADCCAAKYTGRGTCAACADRTTYCKYCCAATTATGTTG + N (SEQ ID NO: 11023) |
| 82 | CAAKYTGRGTCAACADRTTYCKYCCAATTATGTTG + N (SEQ ID NO: 11024) |
| 82 | KYTGRGTCAACADRTTYCKYCCAATTATGTTG + N (SEQ ID NO: 11025) |
| 82 | TGRGTCAACADRTTYCKYCCAATTATGTTG + N (SEQ ID NO: 11026) |
| 82 | GRGTCAACADRTTYCKYCCAATTATGTTG + N (SEQ ID NO: 11027) |

TABLE 8-continued

| Codon | |
|---|---|
| 82 | CADCCAAKYTGRGTCAACADRTTYCKYCCAATTATGTTGA + N (SEQ ID NO: 11028) |
| 82 | CCAAKYTGRGTCAACADRTTYCKYCCAATTATGTTGA + N (SEQ ID NO: 11029) |
| 82 | AKYTGRGTCAACADRTTYCKYCCAATTATGTTGA + N (SEQ ID NO: 11030) |
| 82 | TGRGTCAACADRTTYCKYCCAATTATGTTGA + N (SEQ ID NO: 11031) |
| 82 | RGTCAACADRTTYCKYCCAATTATGTTGA + N (SEQ ID NO: 11032) |
| 82 | GTCAACADRTTYCKYCCAATTATGTTGA + N (SEQ ID NO: 11033) |
| 82 | RAAATTTARWGTRCANCCAAKYTGRGTCAWCADRTTYCKYCCAATTATGTT + N (SEQ ID NO: 11034) |
| 83 | +GTR + CAD + CCAAKYTGRGTCAACADRTTYCKYCCAATTATGT (SEQ ID NO: 11035) |
| 83 | +GTRCAD + CC + AAKYTGRGTCAACADRTTYCKYCCAATTATGT (SEQ ID NO: 11036) |
| 83 | +GTR + CADCC + AAKYTGRGTCAACADRTTYCKYCCAATTATGT (SEQ ID NO: 11037) |
| 83 | +CAD + CC + AAKYTGRGTCAACADRTTYCKYCCAATTATGT (SEQ ID NO: 11038) |
| 83 | +CADCC + A + AKYTGRGTCAACADRTTYCKYCCAATTATGT (SEQ ID NO: 11039) |
| 83 | +CAD + CCA + AKYTGRGTCAACADRTTYCKYCCAATTATGT (SEQ ID NO: 11040) |
| 83 | +CC + A + AKYTGRGTCAACADRTTYCKYCCAATTATGT (SEQ ID NO: 11041) |
| 83 | +CCA + AKY + TGRGTCAACADRTTYCKYCCAATTATGT (SEQ ID NO: 11042) |
| 83 | +CC + AAKY + TGRGTCAACADRTTYCKYCCAATTATGT (SEQ ID NO: 11043) |
| 83 | +A + AKY + TGRGTCAACADRTTYCKYCCAATTATGT (SEQ ID NO: 11044) |
| 83 | +AAKY + TGR + GTCAACADRTTYCKYCCAATTATGT (SEQ ID NO: 11045) |
| 83 | +A + AKYTGR + GTCAACADRTTYCKYCCAATTATGT (SEQ ID NO: 11046) |
| 83 | +AKY + TGR + GTCAACADRTTYCKYCCAATTATGT (SEQ ID NO: 11047) |
| 83 | +AKYTGR + GTC + AACADRTTYCKYCCAATTATGT (SEQ ID NO: 11048) |
| 83 | +AKY + TGRGTC + AACADRTTYCKYCCAATTATGT (SEQ ID NO: 11049) |
| 83 | +TGR + GTC + AACADRTTYCKYCCAATTATGT (SEQ ID NO: 11050) |
| 83 | +TGRGTC + AAC + ADRTTYCKYCCAATTATGT (SEQ ID NO: 11051) |
| 83 | +TGR + GTCAAC + ADRTTYCKYCCAATTATGT (SEQ ID NO: 11052) |
| 83 | GTRCADCCAAKYTGRGTCAACADRTTYCKYCCAATTATGT (SEQ ID NO: 11053) |
| 83 | CADCCAAKYTGRGTCAACADRTTYCKYCCAATTATGT (SEQ ID NO: 11054) |
| 83 | CCAAKYTGRGTCAACADRTTYCKYCCAATTATGT (SEQ ID NO: 11055) |
| 83 | AAKYTGRGTCAACADRTTYCKYCCAATTATGT (SEQ ID NO: 11056) |
| 83 | AKYTGRGTCAACADRTTYCKYCCAATTATGT (SEQ ID NO: 11057) |
| 83 | TGRGTCAACADRTTYCKYCCAATTATGT (SEQ ID NO: 11058) |
| 83 | GGRAAATTTARWGTRCANCCAAKYTGRGTCAWCADRTTYCKYCCAATTAT (SEQ ID NO: 11059) |
| 83 | GTRCADCCAAKYTGRGTCAACADRTTYCKYCCAATTATGT + N (SEQ ID NO: 11060) |
| 83 | CADCCAAKYTGRGTCAACADRTTYCKYCCAATTATGT + N (SEQ ID NO: 11061) |
| 83 | CCAAKYTGRGTCAACADRTTYCKYCCAATTATGT + N (SEQ ID NO: 11062) |
| 83 | AAKYTGRGTCAACADRTTYCKYCCAATTATGT + N (SEQ ID NO: 11063) |
| 83 | AKYTGRGTCAACADRTTYCKYCCAATTATGT + N (SEQ ID NO: 11064) |
| 83 | TGRGTCAACADRTTYCKYCCAATTATGT + N (SEQ ID NO: 11065) |
| 83 | GGRAAATTTARWGTRCANCCAAKYTGRGTCAWCADRTTYCKYCCAATTAT + N (SEQ ID NO: 11066) |

TABLE 8-continued

| Codon | |
|---|---|
| 84 | +ARW + GT + RCADCCAAKYTGRGTCAACADRTTYCKYCCAATTA (SEQ ID NO: 11067) |
| 84 | +ARWGT + R + CADCCAAKYTGRGTCAACADRTTYCKYCCAATTA (SEQ ID NO: 11068) |
| 84 | +ARW + GTR + CADCCAAKYTGRGTCAACADRTTYCKYCCAATTA (SEQ ID NO: 11069) |
| 84 | +GT + R + CADCCAAKYTGRGTCAACADRTTYCKYCCAATTA (SEQ ID NO: 11070) |
| 84 | +GTR + CAD + CCAAKYTGRGTCAACADRTTYCKYCCAATTA (SEQ ID NO: 11071) |
| 84 | +GT + RCAD + CCAAKYTGRGTCAACADRTTYCKYCCAATTA (SEQ ID NO: 11072) |
| 84 | +R + CAD + CCAAKYTGRGTCAACADRTTYCKYCCAATTA (SEQ ID NO: 11073) |
| 84 | +RCAD + CCA + AKYTGRGTCAACADRTTYCKYCCAATTA (SEQ ID NO: 11074) |
| 84 | +R + CADCCA + AKYTGRGTCAACADRTTYCKYCCAATTA (SEQ ID NO: 11075) |
| 84 | +CAD + CCA + AKYTGRGTCAACADRTTYCKYCCAATTA (SEQ ID NO: 11076) |
| 84 | +CADCCA + AKY + TGRGTCAACADRTTYCKYCCAATTA (SEQ ID NO: 11077) |
| 84 | +CAD + CCAAKY + TGRGTCAACADRTTYCKYCCAATTA (SEQ ID NO: 11078) |
| 84 | +CCA + AKY + TGRGTCAACADRTTYCKYCCAATTA (SEQ ID NO: 11079) |
| 84 | +CCAAKY + TGR + GTCAACADRTTYCKYCCAATTA (SEQ ID NO: 11080) |
| 84 | +CCA + AKYTGR + GTCAACADRTTYCKYCCAATTA (SEQ ID NO: 11081) |
| 84 | +AKY + TGR + GTCAACADRTTYCKYCCAATTA (SEQ ID NO: 11082) |
| 84 | +AKYTGR + GTCAAC + ADRTTYCKYCCAATTA (SEQ ID NO: 11083) |
| 84 | +AKY + TGRGTCAAC + ADRTTYCKYCCAATTA (SEQ ID NO: 11084) |
| 84 | ARWGTRCADCCAAKYTGRGTCAACADRTTYCKYCCAATTA (SEQ ID NO: 11085) |
| 84 | GTRCADCCAAKYTGRGTCAACADRTTYCKYCCAATTA (SEQ ID NO: 11086) |
| 84 | RCADCCAAKYTGRGTCAACADRTTYCKYCCAATTA (SEQ ID NO: 11087) |
| 84 | CADCCAAKYTGRGTCAACADRTTYCKYCCAATTA (SEQ ID NO: 11088) |
| 84 | CCAAKYTGRGTCAACADRTTYCKYCCAATTA (SEQ ID NO: 11089) |
| 84 | AKYTGRGTCAACADRTTYCKYCCAATTA (SEQ ID NO: 11090) |
| 84 | RATKGGRAAATTTARWGTRCANCCAAKYTGRGTCAWCADRTTYCKTCCAAT (SEQ ID NO: 11091) |
| 84 | ARWGTRCADCCAAKYTGRGTCAACADRTTYCKYCCAATTA + N (SEQ ID NO: 11092) |
| 84 | GTRCADCCAAKYTGRGTCAACADRTTYCKYCCAATTA + N (SEQ ID NO: 11093) |
| 84 | RCADCCAAKYTGRGTCAACADRTTYCKYCCAATTA + N (SEQ ID NO: 11094) |
| 84 | CADCCAAKYTGRGTCAACADRTTYCKYCCAATTA + N (SEQ ID NO: 11095) |
| 84 | CCAAKYTGRGTCAACADRTTYCKYCCAATTA + N (SEQ ID NO: 11096) |
| 84 | AKYTGRGTCAACADRTTYCKYCCAATTA + N (SEQ ID NO: 11097) |
| 84 | RATKGGRAAATTTARWGTRCANCCAAKYTGRGTCAWCADRTTYCKTCCAAT + N (SEQ ID NO: 11098) |
| 88 | DA + TKG + GRAAAT + TTARWGTRCADCCAAKYTGRGTCAACADR (SEQ ID NO: 11099) |
| 88 | DA + TKGGRAAAT + TTA + RWGTRCADCCAAKYTGRGTCAACADR (SEQ ID NO: 11100) |
| 88 | DA + TKG + GRAAATTTA + RWGTRCADCCAAKYTGRGTCAACADR (SEQ ID NO: 11101) |
| 88 | +GRAAAT + TTA + RWGTRCADCCAAKYTGRGTCAACADR (SEQ ID NO: 11102) |
| 88 | +GRAAATTTA + RW + GTRCADCCAAKYTGRGTCAACADR (SEQ ID NO: 11103) |
| 88 | +GRAAAT + TTARW + GTRCADCCAAKYTGRGTCAACADR (SEQ ID NO: 11104) |

TABLE 8-continued

| Codon | |
|---|---|
| 88 | +TTA + RW + GTRCADCCAAKYTGRGTCAACADR (SEQ ID NO: 11105) |
| 88 | +TTARW + G + TRCADCCAAKYTGRGTCAACADR (SEQ ID NO: 11106) |
| 88 | +TTA + RWG + TRCADCCAAKYTGRGTCAACADR (SEQ ID NO: 11107) |
| 88 | +RW + G + TRCADCCAAKYTGRGTCAACADR (SEQ ID NO: 11108) |
| 88 | +RWG + TR + CADCCAAKYTGRGTCAACADR (SEQ ID NO: 11109) |
| 88 | +RW + GTR + CADCCAAKYTGRGTCAACADR (SEQ ID NO: 11110) |
| 88 | +G + TR + CADCCAAKYTGRGTCAACADR (SEQ ID NO: 11111) |
| 88 | +GTR + C + ADCCAAKYTGRGTCAACADR (SEQ ID NO: 11112) |
| 88 | +G + TRC + ADCCAAKYTGRGTCAACADR (SEQ ID NO: 11113) |
| 88 | +TR + C + ADCCAAKYTGRGTCAACADR (SEQ ID NO: 11114) |
| 88 | +TRC + AD + CCAAKYTGRGTCAACADR (SEQ ID NO: 11115) |
| 88 | +TR + CAD + CCAAKYTGRGTCAACADR (SEQ ID NO: 11116) |
| 88 | DATKGGRAAATTTARWGTRCADCCAAKYTGRGTCAACADR (SEQ ID NO: 11117) |
| 88 | GRAAATTTARWGTRCADCCAAKYTGRGTCAACADR (SEQ ID NO: 11118) |
| 88 | TTARWGTRCADCCAAKYTGRGTCAACADR (SEQ ID NO: 11119) |
| 88 | RWGTRCADCCAAKYTGRGTCAACADR (SEQ ID NO: 11120) |
| 88 | GTRCADCCAAKYTGRGTCAACADR (SEQ ID NO: 11121) |
| 88 | TRCADCCAAKYTGRGTCAACADR (SEQ ID NO: 11122) |
| 88 | TCAATRGGRCTRATKGGRAAATTTARWGTRCANCCAAKYTGRGTCAACAG (SEQ ID NO: 11123) |
| 88 | DATKGGRAAATTTARWGTRCADCCAAKYTGRGTCAACADR + N (SEQ ID NO: 11124) |
| 88 | GRAAATTTARWGTRCADCCAAKYTGRGTCAACADR + N (SEQ ID NO: 11125) |
| 88 | TTARWGTRCADCCAAKYTGRGTCAACADR + N (SEQ ID NO: 11126) |
| 88 | RWGTRCADCCAAKYTGRGTCAACADR + N (SEQ ID NO: 11127) |
| 88 | GTRCADCCAAKYTGRGTCAACADR + N (SEQ ID NO: 11128) |
| 88 | TRCADCCAAKYTGRGTCAACADR + N (SEQ ID NO: 11129) |
| 88 | TCAATRGGRCTRATKGGRAAATTTARWGTRCANCCAAKYTGRGTCAACAG + N (SEQ ID NO: 11130) |
| 89 | +CTD + ATKGGR + AAATTTARWGTRCADCCAAKYTGRGTCAACA (SEQ ID NO: 11131) |
| 89 | +CTDATKGGR + AAA + TTTARWGTRCADCCAAKYTGRGTCAACA (SEQ ID NO: 11132) |
| 89 | +CTD + ATKGGRAAA + TTTARWGTRCADCCAAKYTGRGTCAACA (SEQ ID NO: 11133) |
| 89 | +ATKGGR + AAA + TTTARWGTRCADCCAAKYTGRGTCAACA (SEQ ID NO: 11134) |
| 89 | +ATKGGRAAA + TT + TARWGTRCADCCAAKYTGRGTCAACA (SEQ ID NO: 11135) |
| 89 | +ATKGGR + AAATT + TARWGTRCADCCAAKYTGRGTCAACA (SEQ ID NO: 11136) |
| 89 | +AAA + TT + TARWGTRCADCCAAKYTGRGTCAACA (SEQ ID NO: 11137) |
| 89 | +AAATT + T + ARWGTRCADCCAAKYTGRGTCAACA (SEQ ID NO: 11138) |
| 89 | +AAA + TTT + ARWGTRCADCCAAKYTGRGTCAACA (SEQ ID NO: 11139) |
| 89 | +TT + T + ARWGTRCADCCAAKYTGRGTCAACA (SEQ ID NO: 11140) |
| 89 | +TTT + AR + WGTRCADCCAAKYTGRGTCAACA (SEQ ID NO: 11141) |
| 89 | +TT + TAR + WGTRCADCCAAKYTGRGTCAACA (SEQ ID NO: 11142) |
| 89 | +T + AR + WGTRCADCCAAKYTGRGTCAACA (SEQ ID NO: 11143) |

TABLE 8-continued

| Codon | |
|---|---|
| 89 | +TAR + W + GTRCADCCAAKYTGRGTCAACA (SEQ ID NO: 11144) |
| 89 | +T + ARW + GTRCADCCAAKYTGRGTCAACA (SEQ ID NO: 11145) |
| 89 | +AR + W + GTRCADCCAAKYTGRGTCAACA (SEQ ID NO: 11146) |
| 89 | +ARW + GT + RCADCCAAKYTGRGTCAACA (SEQ ID NO: 11147) |
| 89 | +AR + WGT + RCADCCAAKYTGRGTCAACA (SEQ ID NO: 11148) |
| 89 | CTDATKGGRAAATTTARWGTRCADCCAAKYTGRGTCAACA (SEQ ID NO: 11149) |
| 89 | ATKGGRAAATTTARWGTRCADCCAAKYTGRGTCAACA (SEQ ID NO: 11150) |
| 89 | AAATTTARWGTRCADCCAAKYTGRGTCAACA (SEQ ID NO: 11151) |
| 89 | TTTARWGTRCADCCAAKYTGRGTCAACA (SEQ ID NO: 11152) |
| 89 | TARWGTRCADCCAAKYTGRGTCAACA (SEQ ID NO: 11153) |
| 89 | ARWGTRCADCCAAKYTGRGTCAACA (SEQ ID NO: 11154) |
| 89 | GTBTCAATRGGRCTRATKGGRAAATTTARWGTRCANCCAAKYTGRGTCAA (SEQ ID NO: 11155) |
| 89 | CTDATKGGRAAATTTARWGTRCADCCAAKYTGRGTCAACA + N (SEQ ID NO: 11156) |
| 89 | ATKGGRAAATTTARWGTRCADCCAAKYTGRGTCAACA + N (SEQ ID NO: 11157) |
| 89 | AAATTTARWGTRCADCCAAKYTGRGTCAACA + N (SEQ ID NO: 11158) |
| 89 | TTTARWGTRCADCCAAKYTGRGTCAACA + N (SEQ ID NO: 11159) |
| 89 | TARWGTRCADCCAAKYTGRGTCAACA + N (SEQ ID NO: 11160) |
| 89 | ARWGTRCADCCAAKYTGRGTCAACA + N (SEQ ID NO: 11161) |
| 89 | GTBTCAATRGGRCTRATKGGRAAATTTARWGTRCANCCAAKYTGRGTCAA + N (SEQ ID NO: 11162) |
| 90 | +GGRCTD + ATK + GGRAAATTTARWGTRCADCCAAKYTGRGTCA (SEQ ID NO: 11163) |
| 90 | GGRCTDATK + GG + R + AAATTTARWGTRCADCCAAKYTGRGTCA (SEQ ID NO: 11164) |
| 90 | GGRCTD + ATK + GGR + AAATTTARWGTRCADCCAAKYTGRGTCA (SEQ ID NO: 11165) |
| 90 | +ATK + GG + RAAATTTARWGTRCADCCAAKYTGRGTCA (SEQ ID NO: 11166) |
| 90 | +ATKGG + R + AAATTTARWGTRCADCCAAKYTGRGTCA (SEQ ID NO: 11167) |
| 90 | +ATK + GGR + AAATTTARWGTRCADCCAAKYTGRGTCA (SEQ ID NO: 11168) |
| 90 | +GG + R + AAATTTARWGTRCADCCAAKYTGRGTCA (SEQ ID NO: 11169) |
| 90 | +GGR + AA + ATTTARWGTRCADCCAAKYTGRGTCA (SEQ ID NO: 11170) |
| 90 | +GG + RAA + ATTTARWGTRCADCCAAKYTGRGTCA (SEQ ID NO: 11171) |
| 90 | +R + AA + ATTTARWGTRCADCCAAKYTGRGTCA (SEQ ID NO: 11172) |
| 90 | +RAA + A + TTTARWGTRCADCCAAKYTGRGTCA (SEQ ID NO: 11173) |
| 90 | +R + AAA + TTTARWGTRCADCCAAKYTGRGTCA (SEQ ID NO: 11174) |
| 90 | +AA + A + TTTARWGTRCADCCAAKYTGRGTCA (SEQ ID NO: 11175) |
| 90 | +AAA + TT + TARWGTRCADCCAAKYTGRGTCA (SEQ ID NO: 11176) |
| 90 | +AA + ATT + TARWGTRCADCCAAKYTGRGTCA (SEQ ID NO: 11177) |
| 90 | +A + TT + TARWGTRCADCCAAKYTGRGTCA (SEQ ID NO: 11178) |
| 90 | +ATT + T + ARWGTRCADCCAAKYTGRGTCA (SEQ ID NO: 11179) |
| 90 | +A + TTT + ARWGTRCADCCAAKYTGRGTCA (SEQ ID NO: 11180) |
| 90 | GGRCTDATKGGRAAATTTARWGTRCADCCAAKYTGRGTCA (SEQ ID NO: 11181) |
| 90 | ATKGGRAAATTTARWGTRCADCCAAKYTGRGTCA (SEQ ID NO: 11182) |

TABLE 8-continued

| Codon | |
|---|---|
| 90 | GGRAAATTTARWGTRCADCCAAKYTGRGTCA (SEQ ID NO: 11183) |
| 90 | RAAATTTARWGTRCADCCAAKYTGRGTCA (SEQ ID NO: 11184) |
| 90 | AAATTTARWGTRCADCCAAKYTGRGTCA (SEQ ID NO: 11185) |
| 90 | ATTTARWGTRCADCCAAKYTGRGTCA (SEQ ID NO: 11186) |
| 90 | ACAGTBTCAATRGGRCTRATKGGRAAATTTARWGTRCANCCAAKYTGAGT (SEQ ID NO: 11187) |
| 90 | GGRCTDATKGGRAAATTTARWGTRCADCCAAKYTGRGTCA + N (SEQ ID NO: 11188) |
| 90 | ATKGGRAAATTTARWGTRCADCCAAKYTGRGTCA + N (SEQ ID NO: 11189) |
| 90 | GGRAAATTTARWGTRCADCCAAKYTGRGTCA + N (SEQ ID NO: 11190) |
| 90 | RAAATTTARWGTRCADCCAAKYTGRGTCA + N (SEQ ID NO: 11191) |
| 90 | AAATTTARWGTRCADCCAAKYTGRGTCA + N (SEQ ID NO: 11192) |
| 90 | ATTTARWGTRCADCCAAKYTGRGTCA + N (SEQ ID NO: 11193) |
| 90 | ACAGTBTCAATRGGRCTRATKGGRAAATTTARWGTRCANCCAAKYTGAGT + N (SEQ ID NO: 11194) |

Table 9 depicts amino acid substitutions in HIV-1 protease protein.

TABLE 9

| Codon | Single Letter Amino Acid Code | Amino Acid |
|---|---|---|
| 10 | F | Phenylalanine |
| 10 | R | Arginine |
| 10 | Y | Tyrosine |
| 11 | I | Isoleucine |
| 11 | L | Leucine |
| 20 | T | Threonine |
| 20 | V | Valine |
| 23 | I | Isoleucine |
| 24 | I | Isoleucine |
| 24 | F | Phenylalanine |
| 30 | N | Asparagine |
| 32 | I | Isoleucine |
| 33 | F | Phenylalanine |
| 43 | T | Threonine |
| 46 | I | Isoleucine |
| 46 | L | Leucine |
| 46 | V | Valine |
| 47 | V | Valine |
| 47 | A | Alanine |
| 48 | V | Valine |
| 48 | M | Methionine |
| 48 | A | Alanine |
| 48 | S | Serine |
| 48 | T | Threonine |
| 48 | L | Leucine |
| 48 | Q | Glutamine |
| 50 | V | Valine |
| 50 | L | Leucine |
| 53 | L | Leucine |
| 53 | Y | Tyrosine |
| 54 | V | Valine |
| 54 | T | Threonine |

TABLE 9-continued

| Codon | Single Letter Amino Acid Code | Amino Acid |
|---|---|---|
| 54 | A | Alanine |
| 54 | L | Leucine |
| 54 | S | Serine |
| 54 | M | Methionine |
| 58 | E | Glutamic acid |
| 71 | I | Isoleucine |
| 71 | L | Leucine |
| 71 | L | Leucine |
| 73 | S | Serine |
| 73 | T | Threonine |
| 73 | C | Cysteine |
| 73 | A | Alanine |
| 74 | P | Proline |
| 76 | V | Valine |
| 82 | A | Alanine |
| 82 | T | Threonine |
| 82 | S | Serine |
| 82 | F | Phenylalanine |
| 82 | L | Leucine |
| 82 | C | Cysteine |
| 82 | M | Methionine |
| 83 | D | Aspartic acid |
| 84 | V | Valine |
| 84 | A | Alanine |
| 84 | C | Cysteine |
| 88 | D | Aspartic acid |
| 88 | S | Serine |
| 88 | T | Threonine |
| 88 | G | Glycine |
| 89 | V | Valine |
| 90 | M | Methionine |

Table 10 depicts wild-type and mutant probes for the HIV-1 protease protein. A "+" symbol preceding a nucleotide denotes that the nucleotide is an LNA.

TABLE 10

| Codon | Wild-Type Probe (5' to 3') |
|---|---|
| 10 | CGACCCCTHGTCACA (SEQ ID NO: 11195) |
| 10 | CGACCCTTAGTCACA (SEQ ID NO: 11196) |

TABLE 10 -continued

| | | |
|---|---|---|
| 11 | CCCCTCGTYACAATA | (SEQ ID NO: 11197) |
| 20 | CAACTAAARGAAGCT | (SEQ ID NO: 11198) |
| 23 | ATCTAANAGAGCTTC | (SEQ ID NO: 11199) |
| 23 | ATCTAAYAAAGCTTC | (SEQ ID NO: 11200) |
| 24 | TGTATCYARTAGAGC | (SEQ ID NO: 11201) |
| 30 | TACTGTRTCATCTGC | (SEQ ID NO: 11202) |
| 32 | TTCTAAYACTGTATC | (SEQ ID NO: 11203) |
| 33 | ACAGTACTNGAAGAA | (SEQ ID NO: 11204) |
| 33 | ACAGTATTYGAAGAA | (SEQ ID NO: 11205) |
| 43 | AAATGGAARCCAAAA | (SEQ ID NO: 11206) |
| 46 | CCAAAAATGATAGGG | (SEQ ID NO: 11207) |
| 47 | CCAA + RAATGATAGGRGGAAT | (SEQ ID NO: 11208) |
| 47 | CCAARAAT + GATAGGRGGAAT | (SEQ ID NO: 11209) |
| 47 | CC + AARAATGATAGGRGGAAT | (SEQ ID NO: 11210) |
| 47 | CCAARAA + TGATAGGRGGAAT | (SEQ ID NO: 11211) |
| 47 | CCAARAATGATAGG + RGGAAT | (SEQ ID NO: 11212) |
| 47 | CCAARAATGATAGGR + GGAAT | (SEQ ID NO: 11213) |
| 47 | CCAARAATGATAGGRG + GAAT | (SEQ ID NO: 11214) |
| 47 | CCAARAATGATA + GGRGGAAT | (SEQ ID NO: 11215) |
| 47 | CCA + ARAAT + GA + TAGGRGGAAT | (SEQ ID NO: 11216) |
| 47 | CC + AARAAT + GA + TAGGRGGAAT | (SEQ ID NO: 11217) |
| 47 | C + CAARAAT + GA + TAGGRGGAAT | (SEQ ID NO: 11218) |
| 47 | CCAARAA + T + GA + TAGGRGGAAT | (SEQ ID NO: 11219) |
| 47 | CCAARAAT + GA + TA + GGRGGAAT | (SEQ ID NO: 11220) |
| 47 | CCAARAAT + GA + TAGGR + GGAAT | (SEQ ID NO: 11221) |
| 47 | CCAARAAT + GA + TAG + GRGGAAT | (SEQ ID NO: 11222) |
| 47 | CCAARAAT + GA + TAGGRGG + AAT | (SEQ ID NO: 11223) |
| 47 | CCAA + RAATGATAGGRGGAA | (SEQ ID NO: 11224) |
| 47 | CCAARAAT + GATAGGRGGAA | (SEQ ID NO: 11225) |
| 47 | CC + AARAATGATAGGRGGAA | (SEQ ID NO: 11226) |
| 47 | CCAARAA + TGATAGGRGGAA | (SEQ ID NO: 11227) |
| 47 | CCAARAATGATAGG + RGGAA | (SEQ ID NO: 11228) |
| 47 | CCAARAATGATAGGR + GGAA | (SEQ ID NO: 11229) |
| 47 | CCAARAATGATAGGRG + GAA | (SEQ ID NO: 11230) |
| 47 | CCAARAATGATA + GGRGGAA | (SEQ ID NO: 11231) |
| 47 | CCA + ARAAT + GA + TAGGRGGAA | (SEQ ID NO: 11232) |
| 47 | CC + AARAAT + GA + TAGGRGGAA | (SEQ ID NO: 11233) |
| 47 | C + CAARAAT + GA + TAGGRGGAA | (SEQ ID NO: 11234) |
| 47 | CCAARAA + T + GA + TAGGRGGAA | (SEQ ID NO: 11235) |
| 47 | CCAARAAT + GA + TA + GGRGGAA | (SEQ ID NO: 11236) |

TABLE 10 -continued

| 47 | CCAARAAT + GA + TAGGR + GGAA (SEQ ID NO: 11237) |
| 47 | CCAARAAT + GA + TAG + GRGGAA (SEQ ID NO: 11238) |
| 47 | CCAARAAT + GA + TAGGRGG + AA (SEQ ID NO: 11239) |
| 47 | CAA + RAATGATAGGRGGA (SEQ ID NO: 11240) |
| 47 | CAARAAT + GATAGGRGGA (SEQ ID NO: 11241) |
| 47 | C + AARAATGATAGGRGGA (SEQ ID NO: 11242) |
| 47 | CAARAA + TGATAGGRGGA (SEQ ID NO: 11243) |
| 47 | CAARAATGATAGG + RGGA (SEQ ID NO: 11244) |
| 47 | CAARAATGATAGGR + GGA (SEQ ID NO: 11245) |
| 47 | CAARAATGATAGGRG + GA (SEQ ID NO: 11246) |
| 47 | CAARAATGATA + GGRGGA (SEQ ID NO: 11247) |
| 47 | CA + ARAAT + GA + TAGGRGGA (SEQ ID NO: 11248) |
| 47 | C + AARAAT + GA + TAGGRGGA (SEQ ID NO: 11249) |
| 47 | +CAARAAT + GA + TAGGRGGA (SEQ ID NO: 11250) |
| 47 | CAARAA + T + GA + TAGGRGGA (SEQ ID NO: 11251) |
| 47 | CAARAAT + GA + TA + GGRGGA (SEQ ID NO: 11252) |
| 47 | CAARAAT + GA + TAGGR + GGA (SEQ ID NO: 11253) |
| 47 | CAARAAT + GA + TAG + GRGGA (SEQ ID NO: 11254) |
| 47 | CAARAAT + GA + TAGGRGG + A (SEQ ID NO: 11255) |
| 47 | CAA + RAATGATAGGRG (SEQ ID NO: 11256) |
| 47 | CAARAAT + GATAGGRG (SEQ ID NO: 11257) |
| 47 | C + AARAATGATAGGRG (SEQ ID NO: 11258) |
| 47 | CAARAA + TGATAGGRG (SEQ ID NO: 11259) |
| 47 | CAARAATGATAGG + RG (SEQ ID NO: 11260) |
| 47 | CAARAATGATAGGR + G (SEQ ID NO: 11261) |
| 47 | CAARAATGATAGGRG (SEQ ID NO: 11262) |
| 47 | CAARAATGATA + GGRG (SEQ ID NO: 11263) |
| 47 | CA + ARAAT + GA + TAGGRG (SEQ ID NO: 11264) |
| 47 | C + AARAAT + GA + TAGGRG (SEQ ID NO: 11265) |
| 47 | +CAARAAT + GA + TAGGRG (SEQ ID NO: 11266) |
| 47 | CAARAA + T + GA + TAGGRG (SEQ ID NO: 11267) |
| 47 | CAARAAT + GA + TA + GGRG (SEQ ID NO: 11268) |
| 47 | CAARAAT + GA + TAGGR + G (SEQ ID NO: 11269) |
| 47 | CAARAAT + GA + TAG + GRG (SEQ ID NO: 11270) |
| 47 | CAARAAT + GA + TAGGRGG (SEQ ID NO: 11271) |
| 47 | AAAATGATAGGGGGA (SEQ ID NO: 11272) |
| 47 | CCAARAATGATAGGRGGAAT (SEQ ID NO: 11273) |
| 47 | CCAARAATGATAGGRGGAA (SEQ ID NO: 11274) |
| 47 | CAARAATGATAGGRGGA (SEQ ID NO: 11275) |
| 47 | CAARAATGATAGGRG (SEQ ID NO: 11276) |

TABLE 10 -continued

| | | |
|---|---|---|
| 47 | CAARAATGATAGGRGG | (SEQ ID NO: 11277) |
| 48 | ATGATAGGRGGAATT | (SEQ ID NO: 11278) |
| 50 | ATAGGR + GGAATTGGAGGYTT | (SEQ ID NO: 11279) |
| 50 | ATAG + GRGGAATTGGAGGYTT | (SEQ ID NO: 11280) |
| 50 | ATAGGRG + GAATTGGAGGYTT | (SEQ ID NO: 11281) |
| 50 | AT + AGGRGGAATTGGAGGYTT | (SEQ ID NO: 11282) |
| 50 | ATAGGRGGAATT + GGAGGYTT | (SEQ ID NO: 11283) |
| 50 | ATAGGRGGAATTGGAG + GYTT | (SEQ ID NO: 11284) |
| 50 | ATAGGRGGAA + TTGGAGGYTT | (SEQ ID NO: 11285) |
| 50 | ATAGGRGGAATTGG + AGGYTT | (SEQ ID NO: 11286) |
| 50 | ATAGGR + GG + AA + TTGGAGGYTT | (SEQ ID NO: 11287) |
| 50 | ATAGG + RGG + AA + TTGGAGGYTT | (SEQ ID NO: 11288) |
| 50 | A + TAGGRGG + AA + TTGGAGGYTT | (SEQ ID NO: 11289) |
| 50 | AT + AGGRGG + AA + TTGGAGGYTT | (SEQ ID NO: 11290) |
| 50 | ATAGGRGG + AA + TTGGAGG + YTT | (SEQ ID NO: 11291) |
| 50 | ATAGGRGG + AA + TTGGAG + GYTT | (SEQ ID NO: 11292) |
| 50 | ATAGGRGG + AA + TTG + GAGGYTT | (SEQ ID NO: 11293) |
| 50 | ATAGGRGG + AA + TTGGA + GGYTT | (SEQ ID NO: 11294) |
| 50 | ATAGGR + GGAATTGGAGGYT | (SEQ ID NO: 11295) |
| 50 | ATAG + GRGGAATTGGAGGYT | (SEQ ID NO: 11296) |
| 50 | ATAGGRG + GAATTGGAGGYT | (SEQ ID NO: 11297) |
| 50 | AT + AGGRGGAATTGGAGGYT | (SEQ ID NO: 11298) |
| 50 | ATAGGRGGAATT + GGAGGYT | (SEQ ID NO: 11299) |
| 50 | ATAGGRGGAATTGGAG + GYT | (SEQ ID NO: 11300) |
| 50 | ATAGGRGGAA + TTGGAGGYT | (SEQ ID NO: 11301) |
| 50 | ATAGGRGGAATTGG + AGGYT | (SEQ ID NO: 11302) |
| 50 | ATAGGR + GG + AA + TTGGAGGYT | (SEQ ID NO: 11303) |
| 50 | ATAGG + RGG + AA + TTGGAGGYT | (SEQ ID NO: 11304) |
| 50 | A + TAGGRGG + AA + TTGGAGGYT | (SEQ ID NO: 11305) |
| 50 | AT + AGGRGG + AA + TTGGAGGYT | (SEQ ID NO: 11306) |
| 50 | ATAGGRGG + AA + TTGGAGG + YT | (SEQ ID NO: 11307) |
| 50 | ATAGGRGG + AA + TTGGAG + GYT | (SEQ ID NO: 11308) |
| 50 | ATAGGRGG + AA + TTG + GAGGYT | (SEQ ID NO: 11309) |
| 50 | ATAGGRGG + AA + TTGGA + GGYT | (SEQ ID NO: 11310) |
| 50 | TAGGR + GGAATTGGAGGY | (SEQ ID NO: 11311) |
| 50 | TAG + GRGGAATTGGAGGY | (SEQ ID NO: 11312) |
| 50 | TAGGRG + GAATTGGAGGY | (SEQ ID NO: 11313) |
| 50 | T + AGGRGGAATTGGAGGY | (SEQ ID NO: 11314) |
| 50 | TAGGRGGAATT + GGAGGY | (SEQ ID NO: 11315) |
| 50 | TAGGRGGAATTGGAG + GY | (SEQ ID NO: 11316) |

TABLE 10 -continued

| | |
|---|---|
| 50 | TAGGRGGAA + TTGGAGGY (SEQ ID NO: 11317) |
| 50 | TAGGRGGAATTGG + AGGY (SEQ ID NO: 11318) |
| 50 | TAGGR + GG + AA + TTGGAGGY (SEQ ID NO: 11319) |
| 50 | TAGG + RGG + AA + TTGGAGGY (SEQ ID NO: 11320) |
| 50 | +TAGGRGG + AA + TTGGAGGY (SEQ ID NO: 11321) |
| 50 | T + AGGRGG + AA + TTGGAGGY (SEQ ID NO: 11322) |
| 50 | TAGGRGG + AA + TTGGAGG + Y (SEQ ID NO: 11323) |
| 50 | TAGGRGG + AA + TTGGAG + GY (SEQ ID NO: 11324) |
| 50 | TAGGRGG + AA + TTG + GAGGY (SEQ ID NO: 11325) |
| 50 | TAGGRGG + AA + TTGGA + GGY (SEQ ID NO: 11326) |
| 50 | TAGGR + GGAATTGGAG (SEQ ID NO: 11327) |
| 50 | TAG + GRGGAATTGGAG (SEQ ID NO: 11328) |
| 50 | TAGGRG + GAATTGGAG (SEQ ID NO: 11329) |
| 50 | T + AGGRGGAATTGGAG (SEQ ID NO: 11330) |
| 50 | TAGGRGGAATT + GGAG (SEQ ID NO: 11331) |
| 50 | TAGGRGGAATTGGAG (SEQ ID NO: 11332) |
| 50 | TAGGRGGAA + TTGGAG (SEQ ID NO: 11333) |
| 50 | TAGGRGGAATTGG + AG (SEQ ID NO: 11334) |
| 50 | TAGGR + GG + AA + TTGGAG (SEQ ID NO: 11335) |
| 50 | TAGG + RGG + AA + TTGGAG (SEQ ID NO: 11336) |
| 50 | +TAGGRGG + AA + TTGGAG (SEQ ID NO: 11337) |
| 50 | T + AGGRGG + AA + TTGGAG (SEQ ID NO: 11338) |
| 50 | TAGGRGG + AA + TTGGAGG (SEQ ID NO: 11339) |
| 50 | TAGGRGG + AA + TTGGAG (SEQ ID NO: 11340) |
| 50 | TAGGRGG + AA + TTG + GAG (SEQ ID NO: 11341) |
| 50 | TAGGRGG + AA + TTGGA + G (SEQ ID NO: 11342) |
| 50 | ACCTCCAATTCCCCC (SEQ ID NO: 11343) |
| 50 | ATAGGRGGAATTGGAGGYTT (SEQ ID NO: 11344) |
| 50 | ATAGGRGGAATTGGAGGYT (SEQ ID NO: 11345) |
| 50 | TAGGRGGAATTGGAGGY (SEQ ID NO: 11346) |
| 50 | TAGGRGGAATTGGAG (SEQ ID NO: 11347) |
| 50 | TAGGRGGAATTGGAGG (SEQ ID NO: 11348) |
| 53 | TGGAGGY + TTYATYAARGTAA (SEQ ID NO: 11349) |
| 53 | T + GGAGGYTTYATYAARGTAA (SEQ ID NO: 11350) |
| 53 | TGGAGG + YTTYATYAARGTAA (SEQ ID NO: 11351) |
| 53 | TG + GAGGYTTYATYAARGTAA (SEQ ID NO: 11352) |
| 53 | TGGAGGYTTYATYA + ARGTAA (SEQ ID NO: 11353) |
| 53 | TGGAGGYTTYATYAAR + GTAA (SEQ ID NO: 11354) |
| 53 | TGGAGGYTTY + ATYAARGTAA (SEQ ID NO: 11355) |
| 53 | TGGAGGYTTYATY + AARGTAA (SEQ ID NO: 11356) |

TABLE 10 -continued

| | |
|---|---|
| 53 | TGGA + GGYT + TY + ATYAARGTAA (SEQ ID NO: 11357) |
| 53 | TG + GAGGYT + TY + ATYAARGTAA (SEQ ID NO: 11358) |
| 53 | TGGAGGY + T + TY + ATYAARGTAA (SEQ ID NO: 11359) |
| 53 | TGG + AGGYT + TY + ATYAARGTAA (SEQ ID NO: 11360) |
| 53 | TGGAGGYT + TY + ATY + AARGTAA (SEQ ID NO: 11361) |
| 53 | TGGAGGYT + TY + AT + YAARGTAA (SEQ ID NO: 11362) |
| 53 | TGGAGGYT + TY + ATYAA + RGTAA (SEQ ID NO: 11363) |
| 53 | TGGAGGYT + TY + ATYAAR + GTAA (SEQ ID NO: 11364) |
| 53 | TTGGA + GGYTTTATYAARGTA (SEQ ID NO: 11365) |
| 53 | TTGGAGG + YTTTATYAARGTA (SEQ ID NO: 11366) |
| 53 | TTGGAG + GYTTTATYAARGTA (SEQ ID NO: 11367) |
| 53 | TT + GGAGGYTTTATYAARGTA (SEQ ID NO: 11368) |
| 53 | TTGGAGGYTTTATYAA + RGTA (SEQ ID NO: 11369) |
| 53 | TTGGAGGYTTTATYAAR + GTA (SEQ ID NO: 11370) |
| 53 | TTGGAGGYTTT + ATYAARGTA (SEQ ID NO: 11371) |
| 53 | TTGGAGGYTTTAT + YAARGTA (SEQ ID NO: 11372) |
| 53 | T + TGGAGGY + TT + TATYAARGTA (SEQ ID NO: 11373) |
| 53 | TTGGAG + GY + TT + TATYAARGTA (SEQ ID NO: 11374) |
| 53 | TTGG + AGGY + TT + TATYAARGTA (SEQ ID NO: 11375) |
| 53 | TTGGAGG + Y + TT + TATYAARGTA (SEQ ID NO: 11376) |
| 53 | TTGGAGGY + TT + TATYA + ARGTA (SEQ ID NO: 11377) |
| 53 | TTGGAGGY + TT + T + ATYAARGTA (SEQ ID NO: 11378) |
| 53 | TTGGAGGY + TT + TATYAAR + GTA (SEQ ID NO: 11379) |
| 53 | TTGGAGGY + TT + TATY + AARGTA (SEQ ID NO: 11380) |
| 53 | TGGAGGY + TTYATYAARGTA (SEQ ID NO: 11381) |
| 53 | T + GGAGGYTTYATYAARGTA (SEQ ID NO: 11382) |
| 53 | TGGAGG + YTTYATYAARGTA (SEQ ID NO: 11383) |
| 53 | TG + GAGGYTTYATYAARGTA (SEQ ID NO: 11384) |
| 53 | TGGAGGYTTYATYA + ARGTA (SEQ ID NO: 11385) |
| 53 | TGGAGGYTTYATYAAR + GTA (SEQ ID NO: 11386) |
| 53 | TGGAGGYTTY + ATYAARGTA (SEQ ID NO: 11387) |
| 53 | TGGAGGYTTYATY + AARGTA (SEQ ID NO: 11388) |
| 53 | TGGA + GGYT + TY + ATYAARGTA (SEQ ID NO: 11389) |
| 53 | TG + GAGGYT + TY + ATYAARGTA (SEQ ID NO: 11390) |
| 53 | TGGAGGY + T + TY + ATYAARGTA (SEQ ID NO: 11391) |
| 53 | TGG + AGGYT + TY + ATYAARGTA (SEQ ID NO: 11392) |
| 53 | TGGAGGYT + TY + ATY + AARGTA (SEQ ID NO: 11393) |
| 53 | TGGAGGYT + TY + AT + YAARGTA (SEQ ID NO: 11394) |
| 53 | TGGAGGYT + TY + ATYAA + RGTA (SEQ ID NO: 11395) |
| 53 | TGGAGGYT + TY + ATYAAR + GTA (SEQ ID NO: 11396) |

TABLE 10 -continued

| 53 | TTGGA + GGYTTTATYAARGT (SEQ ID NO: 11397) |
| 53 | TTGGAGG + YTTTATYAARGT (SEQ ID NO: 11398) |
| 53 | TTGGAG + GYTTTATYAARGT (SEQ ID NO: 11399) |
| 53 | TT + GGAGGYTTTATYAARGT (SEQ ID NO: 11400) |
| 53 | TTGGAGGYTTTATYAA + RGT (SEQ ID NO: 11401) |
| 53 | TTGGAGGYTTTATYAAR + GT (SEQ ID NO: 11402) |
| 53 | TTGGAGGYTTT + ATYAARGT (SEQ ID NO: 11403) |
| 53 | TTGGAGGYTTTAT + YAARGT (SEQ ID NO: 11404) |
| 53 | T + TGGAGGY + TT + TATYAARGT (SEQ ID NO: 11405) |
| 53 | TTGGAG + GY + TT + TATYAARGT (SEQ ID NO: 11406) |
| 53 | TTGG + AGGY + TT + TATYAARGT (SEQ ID NO: 11407) |
| 53 | TTGGAGG + Y + TT + TATYAARGT (SEQ ID NO: 11408) |
| 53 | TTGGAGGY + TT + TATYA + ARGT (SEQ ID NO: 11409) |
| 53 | TTGGAGGY + TT + T + ATYAARGT (SEQ ID NO: 11410) |
| 53 | TTGGAGGY + TT + TATYAAR + GT (SEQ ID NO: 11411) |
| 53 | TTGGAGGY + TT + TATY + AARGT (SEQ ID NO: 11412) |
| 53 | GGAGGY + TTYATYAARGT (SEQ ID NO: 11413) |
| 53 | +GGAGGYTTYATYAARGT (SEQ ID NO: 11414) |
| 53 | GGAGG + YTTYATYAARGT (SEQ ID NO: 11415) |
| 53 | G + GAGGYTTYATYAARGT (SEQ ID NO: 11416) |
| 53 | GGAGGYTTYATYA + ARGT (SEQ ID NO: 11417) |
| 53 | GGAGGYTTYATYAAR + GT (SEQ ID NO: 11418) |
| 53 | GGAGGYTTY + ATYAARGT (SEQ ID NO: 11419) |
| 53 | GGAGGYTTYATY + AARGT (SEQ ID NO: 11420) |
| 53 | GGA + GGYT + TY + ATYAARGT (SEQ ID NO: 11421) |
| 53 | G + GAGGYT + TY + ATYAARGT (SEQ ID NO: 11422) |
| 53 | GGAGGY + T + TY + ATYAARGT (SEQ ID NO: 11423) |
| 53 | GG + AGGYT + TY + ATYAARGT (SEQ ID NO: 11424) |
| 53 | GGAGGYT + TY + ATY + AARGT (SEQ ID NO: 11425) |
| 53 | GGAGGYT + TY + AT + YAARGT (SEQ ID NO: 11426) |
| 53 | GGAGGYT + TY + ATYAA + RGT (SEQ ID NO: 11427) |
| 53 | GGAGGYT + TY + ATYAAR + GT (SEQ ID NO: 11428) |
| 53 | TGGA + GGYTTTATYAARG (SEQ ID NO: 11429) |
| 53 | TGGAGG + YTTTATYAARG (SEQ ID NO: 11430) |
| 53 | TGGAG + GYTTTATYAARG (SEQ ID NO: 11431) |
| 53 | T + GGAGGYTTTATYAARG (SEQ ID NO: 11432) |
| 53 | TGGAGGYTTTATYAA + RG (SEQ ID NO: 11433) |
| 53 | TGGAGGYTTTATYAAR + G (SEQ ID NO: 11434) |
| 53 | TGGAGGYTTT + ATYAARG (SEQ ID NO: 11435) |
| 53 | TGGAGGYTTTAT + YAARG (SEQ ID NO: 11436) |

TABLE 10 -continued

| | |
|---|---|
| 53 | +TGGAGGY + TT + TATYAARG (SEQ ID NO: 11437) |
| 53 | TGGAG + GY + TT + TATYAARG (SEQ ID NO: 11438) |
| 53 | TGG + AGGY + TT + TATYAARG (SEQ ID NO: 11439) |
| 53 | TGGAGG + Y + TT + TATYAARG (SEQ ID NO: 11440) |
| 53 | TGGAGGY + TT + TATYA + ARG (SEQ ID NO: 11441) |
| 53 | TGGAGGY + TT + T + ATYAARG (SEQ ID NO: 11442) |
| 53 | TGGAGGY + TT + TATYAAR + G (SEQ ID NO: 11443) |
| 53 | TGGAGGY + TT + TATY + AARG (SEQ ID NO: 11444) |
| 53 | GGAGGY + TTYATYAAR (SEQ ID NO: 11445) |
| 53 | +GGAGGYTTYATYAAR (SEQ ID NO: 11446) |
| 53 | GGAGG + YTTYATYAAR (SEQ ID NO: 11447) |
| 53 | G + GAGGYTTYATYAAR (SEQ ID NO: 11448) |
| 53 | GGAGGYTTYATYA + AR (SEQ ID NO: 11449) |
| 53 | GGAGGYTTYATYAAR (SEQ ID NO: 11450) |
| 53 | GGAGGYTTY + ATYAAR (SEQ ID NO: 11451) |
| 53 | GGAGGYTTYATY + AAR (SEQ ID NO: 11452) |
| 53 | GGA + GGYT + TY + ATYAAR (SEQ ID NO: 11453) |
| 53 | G + GAGGYT + TY + ATYAAR (SEQ ID NO: 11454) |
| 53 | GGAGGY + T + TY + ATYAAR (SEQ ID NO: 11455) |
| 53 | GG + AGGYT + TY + ATYAAR (SEQ ID NO: 11456) |
| 53 | GGAGGYT + TY + ATY + AAR (SEQ ID NO: 11457) |
| 53 | GGAGGYT + TY + AT + YAAR (SEQ ID NO: 11458) |
| 53 | GGAGGYT + TY + ATYAA + R (SEQ ID NO: 11459) |
| 53 | GGAGGYT + TY + ATYAAR (SEQ ID NO: 11460) |
| 53 | TGGA + GGYTTTATYAA (SEQ ID NO: 11461) |
| 53 | TGGAGG + YTTTATYAA (SEQ ID NO: 11462) |
| 53 | TGGAG + GYTTTATYAA (SEQ ID NO: 11463) |
| 53 | T + GGAGGYTTTATYAA (SEQ ID NO: 11464) |
| 53 | TGGAGGYTTTATYAA (SEQ ID NO: 11465) |
| 53 | TGGAGGYTTTATYAAR (SEQ ID NO: 11466) |
| 53 | TGGAGGYTTT + ATYAA (SEQ ID NO: 11467) |
| 53 | TGGAGGYTTTAT + YAA (SEQ ID NO: 11468) |
| 53 | +TGGAGGY + TT +TATYAA (SEQ ID NO: 11469) |
| 53 | TGGAG + GY + TT + TATYAA (SEQ ID NO: 11470) |
| 53 | TGG + AGGY + TT + TATYAA (SEQ ID NO: 11471) |
| 53 | TGGAGG + Y + TT + TATYAA (SEQ ID NO: 11472) |
| 53 | TGGAGGY + TT + TATYA + A (SEQ ID NO: 11473) |
| 53 | TGGAGGY + TT + T + ATYAA (SEQ ID NO: 11474) |
| 53 | TGGAGGY + TT + TATYAAR (SEQ ID NO: 11475) |
| 53 | TGGAGGY + TT + TATY + AA (SEQ ID NO: 11476) |

TABLE 10 -continued

| | |
|---|---|
| 53 | TTTGATRAAACCTCC (SEQ ID NO: 11477) |
| 53 | TGGAGGYTTYATYAARGTAA (SEQ ID NO: 11478) |
| 53 | TTGGAGGYTTTATYAARGTA (SEQ ID NO: 11479) |
| 53 | TGGAGGYTTYATYAARGTA (SEQ ID NO: 11480) |
| 53 | TTGGAGGYTTTATYAARGT (SEQ ID NO: 11481) |
| 53 | GGAGGYTTYATYAARGT (SEQ ID NO: 11482) |
| 53 | TGGAGGYTTTATYAARG (SEQ ID NO: 11483) |
| 53 | GGAGGYTTYATYAAR (SEQ ID NO: 11484) |
| 53 | TGGAGGYTTTATYAA (SEQ ID NO: 11485) |
| 54 | AGGYT + TTATYAARGTAARRC (SEQ ID NO: 11486) |
| 54 | AGGYTTTA + TYAARGTAARRC (SEQ ID NO: 11487) |
| 54 | AGGYTT + TATYAARGTAARRC (SEQ ID NO: 11488) |
| 54 | AGGYTTT + ATYAARGTAARRC (SEQ ID NO: 11489) |
| 54 | AGGYTTTATY + AARGTAARRC (SEQ ID NO: 11490) |
| 54 | AGGYTTTATYAARG + TAARRC (SEQ ID NO: 11491) |
| 54 | AGGYTTTATYAARGTA + ARRC (SEQ ID NO: 11492) |
| 54 | AGGYTTTATYAA + RGTAARRC (SEQ ID NO: 11493) |
| 54 | AGGYT + TTA + TY + AARGTAARRC (SEQ ID NO: 11494) |
| 54 | AGGY + TTTA + TY + AARGTAARRC (SEQ ID NO: 11495) |
| 54 | AGG + YTTTA + TY + AARGTAARRC (SEQ ID NO: 11496) |
| 54 | AG + GYTTTA + TY + AARGTAARRC (SEQ ID NO: 11497) |
| 54 | AGGYTTTA + TY + AAR + GTAARRC (SEQ ID NO: 11498) |
| 54 | AGGYTTTA + TY + AARGTAAR + RC (SEQ ID NO: 11499) |
| 54 | AGGYTTTA + TY + AA + RGTAARRC (SEQ ID NO: 11500) |
| 54 | AGGYTTTA + TY + A + ARGTAARRC (SEQ ID NO: 11501) |
| 54 | GAGGYT + TTATYAARGTAARR (SEQ ID NO: 11502) |
| 54 | GA + GGYTTTATYAARGTAARR (SEQ ID NO: 11503) |
| 54 | GAGGYTT + TATYAARGTAARR (SEQ ID NO: 11504) |
| 54 | GAG + GYTTTATYAARGTAARR (SEQ ID NO: 11505) |
| 54 | GAGGYTTTAT + YAARGTAARR (SEQ ID NO: 11506) |
| 54 | GAGGYTTTATYAA + RGTAARR (SEQ ID NO: 11507) |
| 54 | GAGGYTTTATYAARGT + AARR (SEQ ID NO: 11508) |
| 54 | GAGGYTTTATY + AARGTAARR (SEQ ID NO: 11509) |
| 54 | GAGGYT + TT + AT + YAARGTAARR (SEQ ID NO: 11510) |
| 54 | GAG + GYTTT + AT + YAARGTAARR (SEQ ID NO: 11511) |
| 54 | GA + GGYTTT + AT + YAARGTAARR (SEQ ID NO: 11512) |
| 54 | GAGG + YTTT + AT + YAARGTAARR (SEQ ID NO: 11513) |
| 54 | GAGGYTTT + AT + YAARGT + AARR (SEQ ID NO: 11514) |
| 54 | GAGGYTTT + AT + YAARG + TAARR (SEQ ID NO: 11515) |
| 54 | GAGGYTTT + AT + YAA + RGTAARR (SEQ ID NO: 11516) |

TABLE 10 -continued

| | | |
|---|---|---|
| 54 | GAGGYTTT + AT + Y + AARGTAARR | (SEQ ID NO: 11517) |
| 54 | GGA + GGYTTTATYAARGTAAR | (SEQ ID NO: 11518) |
| 54 | G + GAGGYTTTATYAARGTAAR | (SEQ ID NO: 11519) |
| 54 | GG + AGGYTTTATYAARGTAAR | (SEQ ID NO: 11520) |
| 54 | GGAGGY + TTTATYAARGTAAR | (SEQ ID NO: 11521) |
| 54 | GGAGGYTTTATY + AARGTAAR | (SEQ ID NO: 11522) |
| 54 | GGAGGYTTTATYAARGT + AAR | (SEQ ID NO: 11523) |
| 54 | GGAGGYTTTATYAARG + TAAR | (SEQ ID NO: 11524) |
| 54 | GGAGGYTTTATYAARGTA + AR | (SEQ ID NO: 11525) |
| 54 | GG + AGGYTT + TA + TYAARGTAAR | (SEQ ID NO: 11526) |
| 54 | G + GAGGYTT + TA + TYAARGTAAR | (SEQ ID NO: 11527) |
| 54 | GGAGGY + TT + TA + TYAARGTAAR | (SEQ ID NO: 11528) |
| 54 | GGA + GGYTT + TA + TYAARGTAAR | (SEQ ID NO: 11529) |
| 54 | GGAGGYTT + TA + TYAA + RGTAAR | (SEQ ID NO: 11530) |
| 54 | GGAGGYTT + TA + TYA + ARGTAAR | (SEQ ID NO: 11531) |
| 54 | GGAGGYTT + TA + TYAAR + GTAAR | (SEQ ID NO: 11532) |
| 54 | GGAGGYTT + TA + TY + AARGTAAR | (SEQ ID NO: 11533) |
| 54 | AGGYT + TTATYAARGTAARR | (SEQ ID NO: 11534) |
| 54 | AGGYTTTA + TYAARGTAARR | (SEQ ID NO: 11535) |
| 54 | AGGYTT + TATYAARGTAARR | (SEQ ID NO: 11536) |
| 54 | AGGYTTT + ATYAARGTAARR | (SEQ ID NO: 11537) |
| 54 | AGGYTTTATY + AARGTAARR | (SEQ ID NO: 11538) |
| 54 | AGGYTTTATYAARG + TAARR | (SEQ ID NO: 11539) |
| 54 | AGGYTTTATYAARGTA + ARR | (SEQ ID NO: 11540) |
| 54 | AGGYTTTATYAA + RGTAARR | (SEQ ID NO: 11541) |
| 54 | AGGYT + TTA + TY + AARGTAARR | (SEQ ID NO: 11542) |
| 54 | AGGY + TTTA + TY + AARGTAARR | (SEQ ID NO: 11543) |
| 54 | AGG + YTTTA + TY + AARGTAARR | (SEQ ID NO: 11544) |
| 54 | AG + GYTTTA + TY + AARGTAARR | (SEQ ID NO: 11545) |
| 54 | AGGYTTTA + TY + AAR + GTAARR | (SEQ ID NO: 11546) |
| 54 | AGGYTTTA + TY + AARGTAAR + R | (SEQ ID NO: 11547) |
| 54 | AGGYTTTA + TY + AA + RGTAARR | (SEQ ID NO: 11548) |
| 54 | AGGYTTTA + TY + A + ARGTAARR | (SEQ ID NO: 11549) |
| 54 | GAGGYT + TTATYAARGTAAR | (SEQ ID NO: 11550) |
| 54 | GA + GGYTTTATYAARGTAAR | (SEQ ID NO: 11551) |
| 54 | GAGGYTT + TATYAARGTAAR | (SEQ ID NO: 11552) |
| 54 | GAG + GYTTTATYAARGTAAR | (SEQ ID NO: 11553) |
| 54 | GAGGYTTTAT + YAARGTAAR | (SEQ ID NO: 11554) |
| 54 | GAGGYTTTATYAA + RGTAAR | (SEQ ID NO: 11555) |
| 54 | GAGGYTTTATYAARGT + AAR | (SEQ ID NO: 11556) |

TABLE 10 -continued

| | |
|---|---|
| 54 | GAGGYTTTATY + AARGTAAR (SEQ ID NO: 11557) |
| 54 | GAGGYT + TT + AT + YAARGTAAR (SEQ ID NO: 11558) |
| 54 | GAG + GYTTT + AT + YAARGTAAR (SEQ ID NO: 11559) |
| 54 | GA + GGYTT + AT + YAARGTAAR (SEQ ID NO: 11560) |
| 54 | GAGG + YTTT + AT + YAARGTAAR (SEQ ID NO: 11561) |
| 54 | GAGGYTTT + AT + YAARGT + AAR (SEQ ID NO: 11562) |
| 54 | GAGGYTTT + AT + YAARG + TAAR (SEQ ID NO: 11563) |
| 54 | GAGGYTTT + AT + YAA + RGTAAR (SEQ ID NO: 11564) |
| 54 | GAGGYTTT + AT + Y + AARGTAAR (SEQ ID NO: 11565) |
| 54 | GGA + GGYTTTATYAARGTAA (SEQ ID NO: 11566) |
| 54 | G + GAGGYTTTATYAARGTAA (SEQ ID NO: 11567) |
| 54 | GG + AGGYTTTATYAARGTAA (SEQ ID NO: 11568) |
| 54 | GGAGGY + TTTATYAARGTAA (SEQ ID NO: 11569) |
| 54 | GGAGGYTTTATY + AARGTAA (SEQ ID NO: 11570) |
| 54 | GGAGGYTTTATYAARGT + AA (SEQ ID NO: 11571) |
| 54 | GGAGGYTTTATYAARG + TAA (SEQ ID NO: 11572) |
| 54 | GGAGGYTTTATYAARGTA + A (SEQ ID NO: 11573) |
| 54 | GG + AGGYTT + TA + TYAARGTAA (SEQ ID NO: 11574) |
| 54 | G + GAGGYTT + TA + TYAARGTAA (SEQ ID NO: 11575) |
| 54 | GGAGGY + TT + TA + TYAARGTAA (SEQ ID NO: 11576) |
| 54 | GGA + GGYTT + TA + TYAARGTAA (SEQ ID NO: 11577) |
| 54 | GGAGGYTT + TA + TYAA + RGTAA (SEQ ID NO: 11578) |
| 54 | GGAGGYTT + TA + TYA + ARGTAA (SEQ ID NO: 11579) |
| 54 | GGAGGYTT + TA + TYAAR + GTAA (SEQ ID NO: 11580) |
| 54 | GGAGGYTT + TA + TY + AARGTAA (SEQ ID NO: 11581) |
| 54 | GGYT + TTATYAARGTAAR (SEQ ID NO: 11582) |
| 54 | GGYTTTA + TYAARGTAAR (SEQ ID NO: 11583) |
| 54 | GGYTT + TATYAARGTAAR (SEQ ID NO: 11584) |
| 54 | GGYTTT + ATYAARGTAAR (SEQ ID NO: 11585) |
| 54 | GGYTTTATY + AARGTAAR (SEQ ID NO: 11586) |
| 54 | GGYTTTATYAARG + TAAR (SEQ ID NO: 11587) |
| 54 | GGYTTTATYAARGTA + AR (SEQ ID NO: 11588) |
| 54 | GGYTTTATYAA + RGTAAR (SEQ ID NO: 11589) |
| 54 | GGYT + TTA + TY + AARGTAAR (SEQ ID NO: 11590) |
| 54 | GGY + TTTA + TY + AARGTAAR (SEQ ID NO: 11591) |
| 54 | GG + YTTTA + TY + AARGTAAR (SEQ ID NO: 11592) |
| 54 | G + GYTTTA + TY + AARGTAAR (SEQ ID NO: 11593) |
| 54 | GGYTTTA + TY + AAR + GTAAR (SEQ ID NO: 11594) |
| 54 | GGYTTTA + TY + AARGTAAR (SEQ ID NO: 11595) |
| 54 | GGYTTTA + TY + AA + RGTAAR (SEQ ID NO: 11596) |

TABLE 10 -continued

| | |
|---|---|
| 54 | GGYTTTA + TY + A + ARGTAAR (SEQ ID NO: 11597) |
| 54 | AGGYT + TTATYAARGTAA (SEQ ID NO: 11598) |
| 54 | A + GGYTTTATYAARGTAA (SEQ ID NO: 11599) |
| 54 | AGGYTT + TATYAARGTAA (SEQ ID NO: 11600) |
| 54 | AG + GYTTTATYAARGTAA (SEQ ID NO: 11601) |
| 54 | AGGYTTTAT + YAARGTAA (SEQ ID NO: 11602) |
| 54 | AGGYTTTATYAA + RGTAA (SEQ ID NO: 11603) |
| 54 | AGGYTTTATYAARGT + AA (SEQ ID NO: 11604) |
| 54 | AGGYTTTATY + AARGTAA (SEQ ID NO: 11605) |
| 54 | AGGYT + TT + AT + YAARGTAA (SEQ ID NO: 11606) |
| 54 | AG + GYTTT + AT + YAARGTAA (SEQ ID NO: 11607) |
| 54 | A + GGYTTT + AT + YAARGTAA (SEQ ID NO: 11608) |
| 54 | AGG + YTTT + AT + YAARGTAA (SEQ ID NO: 11609) |
| 54 | AGGYTTT + AT + YAARGT + AA (SEQ ID NO: 11610) |
| 54 | AGGYTTT + AT + YAARG + TAA (SEQ ID NO: 11611) |
| 54 | AGGYTTT + AT + YAA + RGTAA (SEQ ID NO: 11612) |
| 54 | AGGYTTT + AT + Y + AARGTAA (SEQ ID NO: 11613) |
| 54 | GA + GGYTTTATYAARGTA (SEQ ID NO: 11614) |
| 54 | +GAGGYTTTATYAARGTA (SEQ ID NO: 11615) |
| 54 | G + AGGYTTTATYAARGTA (SEQ ID NO: 11616) |
| 54 | GAGGY + TTTATYAARGTA (SEQ ID NO: 11617) |
| 54 | GAGGYTTTATY + AARGTA (SEQ ID NO: 11618) |
| 54 | GAGGYTTTATYAARGT + A (SEQ ID NO: 11619) |
| 54 | GAGGYTTTATYAARG + TA (SEQ ID NO: 11620) |
| 54 | GAGGYTTTATYAARGTA (SEQ ID NO: 11621) |
| 54 | G + AGGYTT + TA + TYAARGTA (SEQ ID NO: 11622) |
| 54 | +GAGGYTT + TA + TYAARGTA (SEQ ID NO: 11623) |
| 54 | GAGGY + TT + TA + TYAARGTA (SEQ ID NO: 11624) |
| 54 | GA + GGYTT + TA + TYAARGTA (SEQ ID NO: 11625) |
| 54 | GAGGYTT + TA + TYAA + RGTA (SEQ ID NO: 11626) |
| 54 | GAGGYTT + TA + TYA + ARGTA (SEQ ID NO: 11627) |
| 54 | GAGGYTT + TA + TYAAR + GTA (SEQ ID NO: 11628) |
| 54 | GAGGYTT + TA + TY + AARGTA (SEQ ID NO: 11629) |
| 54 | GGYT + TTATYAARGTA (SEQ ID NO: 11630) |
| 54 | GGYTTTA + TYAARGTA (SEQ ID NO: 11631) |
| 54 | GGYTT + TATYAARGTA (SEQ ID NO: 11632) |
| 54 | GGYTTT + ATYAARGTA (SEQ ID NO: 11633) |
| 54 | GGYTTTATY + AARGTA (SEQ ID NO: 11634) |
| 54 | GGYTTTATYAARG + TA (SEQ ID NO: 11635) |
| 54 | GGYTTTATYAARGTA (SEQ ID NO: 11636) |

TABLE 10 -continued

| | |
|---|---|
| 54 | GGYTTTATYAA + RGTA (SEQ ID NO: 11637) |
| 54 | GGYT + TTA + TY + AARGTA (SEQ ID NO: 11638) |
| 54 | GGY + TTTA + TY + AARGTA (SEQ ID NO: 11639) |
| 54 | GG + YTTTA + TY + AARGTA (SEQ ID NO: 11640) |
| 54 | G + GYTTTA + TY + AARGTA (SEQ ID NO: 11641) |
| 54 | GGYTTTA + TY + AAR + GTA (SEQ ID NO: 11642) |
| 54 | GGYTTTA + TY + AARGTAA (SEQ ID NO: 11643) |
| 54 | GGYTTTA + TY + AA + RGTA (SEQ ID NO: 11644) |
| 54 | GGYTTTA + TY + A + ARGTA (SEQ ID NO: 11645) |
| 54 | AGGYT + TTATYAARGT (SEQ ID NO: 11646) |
| 54 | A + GGYTTTATYAARGT (SEQ ID NO: 11647) |
| 54 | AGGYTT + TATYAARGT (SEQ ID NO: 11648) |
| 54 | AG + GYTTTATYAARGT (SEQ ID NO: 11649) |
| 54 | AGGYTTTAT + YAARGT (SEQ ID NO: 11650) |
| 54 | AGGYTTTATYAA + RGT (SEQ ID NO: 11651) |
| 54 | AGGYTTTATYAARGT (SEQ ID NO: 11652) |
| 54 | AGGYTTTATY + AARGT (SEQ ID NO: 11653) |
| 54 | AGGYT + TT + AT + YAARGT (SEQ ID NO: 11654) |
| 54 | AG + GYTTT + AT + YAARGT (SEQ ID NO: 11655) |
| 54 | A + GGYTTT + AT + YAARGT (SEQ ID NO: 11656) |
| 54 | AGG + YTTT + AT + YAARGT (SEQ ID NO: 11657) |
| 54 | AGGYTTT + AT + YAARGT (SEQ ID NO: 11658) |
| 54 | AGGYTTT + AT + YAARG + T (SEQ ID NO: 11659) |
| 54 | AGGYTTT + AT + YAA + RGT (SEQ ID NO: 11660) |
| 54 | AGGYTTT + AT + Y + AARGT (SEQ ID NO: 11661) |
| 54 | GA + GGYTTTATYAARG (SEQ ID NO: 11662) |
| 54 | +GAGGYTTTATYAARG (SEQ ID NO: 11663) |
| 54 | G + AGGYTTTATYAARG (SEQ ID NO: 11664) |
| 54 | GAGGY + TTTATYAARG (SEQ ID NO: 11665) |
| 54 | GAGGYTTTATY + AARG (SEQ ID NO: 11666) |
| 54 | GAGGYTTTATYAARGT (SEQ ID NO: 11667) |
| 54 | GAGGYTTTATYAARG (SEQ ID NO: 11668) |
| 54 | G + AGGYTT + TA + TYAARG (SEQ ID NO: 11669) |
| 54 | +GAGGYTT + TA + TYAARG (SEQ ID NO: 11670) |
| 54 | GAGGY + TT + TA + TYAARG (SEQ ID NO: 11671) |
| 54 | GA + GGYTT + TA + TYAARG (SEQ ID NO: 11672) |
| 54 | GAGGYTT + TA + TYAA + RG (SEQ ID NO: 11673) |
| 54 | GAGGYTT + TA + TYA + ARG (SEQ ID NO: 11674) |
| 54 | GAGGYTT + TA + TYAAR + G (SEQ ID NO: 11675) |
| 54 | GAGGYTT + TA + TY + AARG (SEQ ID NO: 11676) |

TABLE 10 -continued

| | |
|---|---|
| 54 | TACTTTRATAAAACC (SEQ ID NO: 11677) |
| 54 | AGGYTTTATYAARGTAARRC (SEQ ID NO: 11678) |
| 54 | GAGGYTTTATYAARGTAARR (SEQ ID NO: 11679) |
| 54 | GGAGGYTTTATYAARGTAAR (SEQ ID NO: 11680) |
| 54 | AGGYTTTATYAARGTAARR (SEQ ID NO: 11681) |
| 54 | GAGGYTTTATYAARGTAAR (SEQ ID NO: 11682) |
| 54 | GGAGGYTTTATYAARGTAA (SEQ ID NO: 11683) |
| 54 | GGYTTTATYAARGTAAR (SEQ ID NO: 11684) |
| 54 | AGGYTTTATYAARGTAA (SEQ ID NO: 11685) |
| 54 | GAGGYTTTATYAARGTA (SEQ ID NO: 11686) |
| 54 | GGYTTTATYAARGTA (SEQ ID NO: 11687) |
| 54 | GGYTTTATYAARGTAA (SEQ ID NO: 11688) |
| 54 | AGGYTTTATYAARGT (SEQ ID NO: 11689) |
| 54 | GAGGYTTTATYAARG (SEQ ID NO: 11690) |
| 58 | AA + RGTAARRCARTATGAKSA (SEQ ID NO: 11691) |
| 58 | AARGTAA + RRCARTATGAKSA (SEQ ID NO: 11692) |
| 58 | A + ARGTAARRCARTATGAKSA (SEQ ID NO: 11693) |
| 58 | AARGTAAR + RCARTATGAKSA (SEQ ID NO: 11694) |
| 58 | AARGTAARRCART + ATGAKSA (SEQ ID NO: 11695) |
| 58 | AARGTAARRCARTATGAK + SA (SEQ ID NO: 11696) |
| 58 | AARGTAARRCA + RTATGAKSA (SEQ ID NO: 11697) |
| 58 | AARGTAARRCAR + TATGAKSA (SEQ ID NO: 11698) |
| 58 | AA + RGTAAR + RC + ARTATGAKSA (SEQ ID NO: 11699) |
| 58 | AARG + TAAR + RC + ARTATGAKSA (SEQ ID NO: 11700) |
| 58 | AAR + GTAAR + RC + ARTATGAKSA (SEQ ID NO: 11701) |
| 58 | A + ARGTAAR + RC + ARTATGAKSA (SEQ ID NO: 11702) |
| 58 | AARGTAAR + RC + ARTATGAK + SA (SEQ ID NO: 11703) |
| 58 | AARGTAAR + RC + ARTAT + GAKSA (SEQ ID NO: 11704) |
| 58 | AARGTAAR + RC + ARTA + TGAKSA (SEQ ID NO: 11705) |
| 58 | AARGTAAR + RC + AR + TATGAKSA (SEQ ID NO: 11706) |
| 58 | AA + RGTAARRCARTATGAKS (SEQ ID NO: 11707) |
| 58 | AARGTAA + RRCARTATGAKS (SEQ ID NO: 11708) |
| 58 | A + ARGTAARRCARTATGAKS (SEQ ID NO: 11709) |
| 58 | AARGTAAR + RCARTATGAKS (SEQ ID NO: 11710) |
| 58 | AARGTAARRCART + ATGAKS (SEQ ID NO: 11711) |
| 58 | AARGTAARRCARTATGAK + S (SEQ ID NO: 11712) |
| 58 | AARGTAARRCA + RTATGAKS (SEQ ID NO: 11713) |
| 58 | AARGTAARRCAR + TATGAKS (SEQ ID NO: 11714) |
| 58 | AA + RGTAAR + RC + ARTATGAKS (SEQ ID NO: 11715) |
| 58 | AARG + TAAR + RC + ARTATGAKS (SEQ ID NO: 11716) |

TABLE 10 -continued

| | |
|---|---|
| 58 | AAR + GTAAR + RC + ARTATGAKS (SEQ ID NO: 11717) |
| 58 | A + ARGTAAR + RC + ARTATGAKS (SEQ ID NO: 11718) |
| 58 | AARGTAAR + RC + ARTATGAK + S (SEQ ID NO: 11719) |
| 58 | AARGTAAR + RC + ARTAT + GAKS (SEQ ID NO: 11720) |
| 58 | AARGTAAR + RC + ARTA + TGAKS (SEQ ID NO: 11721) |
| 58 | AARGTAAR + RC + AR + TATGAKS (SEQ ID NO: 11722) |
| 58 | A + RGTAARRCARTATGAK (SEQ ID NO: 11723) |
| 58 | ARGTAA + RRCARTATGAK (SEQ ID NO: 11724) |
| 58 | +ARGTAARRCARTATGAK (SEQ ID NO: 11725) |
| 58 | ARGTAAR + RCARTATGAK (SEQ ID NO: 11726) |
| 58 | ARGTAARRCART + ATGAK (SEQ ID NO: 11727) |
| 58 | ARGTAARRCARTATGAK (SEQ ID NO: 11728) |
| 58 | ARGTAARRCA + RTATGAK (SEQ ID NO: 11729) |
| 58 | ARGTAARRCAR + TATGAK (SEQ ID NO: 11730) |
| 58 | A + RGTAAR + RC + ARTATGAK (SEQ ID NO: 11731) |
| 58 | ARG + TAAR + RC + ARTATGAK (SEQ ID NO: 11732) |
| 58 | AR + GTAAR + RC + ARTATGAK (SEQ ID NO: 11733) |
| 58 | +ARGTAAR + RC + ARTATGAK (SEQ ID NO: 11734) |
| 58 | ARGTAAR + RC + ARTATGAK (SEQ ID NO: 11735) |
| 58 | ARGTAAR + RC + ARTAT + GAK (SEQ ID NO: 11736) |
| 58 | ARGTAAR + RC + ARTA + TGAK (SEQ ID NO: 11737) |
| 58 | ARGTAAR + RC + AR + TATGAK (SEQ ID NO: 11738) |
| 58 | A + RGTAARRCARTATG (SEQ ID NO: 11739) |
| 58 | ARGTAA + RRCARTATG (SEQ ID NO: 11740) |
| 58 | +ARGTAARRCARTATG (SEQ ID NO: 11741) |
| 58 | ARGTAAR + RCARTATG (SEQ ID NO: 11742) |
| 58 | ARGTAARRCART + ATG (SEQ ID NO: 11743) |
| 58 | ARGTAARRCARTATGA (SEQ ID NO: 11744) |
| 58 | ARGTAARRCA + RTATG (SEQ ID NO: 11745) |
| 58 | ARGTAARRCAR + TATG (SEQ ID NO: 11746) |
| 58 | A + RGTAAR + RC + ARTATG (SEQ ID NO: 11747) |
| 58 | ARG + TAAR + RC + ARTATG (SEQ ID NO: 11748) |
| 58 | AR + GTAAR + RC + ARTATG (SEQ ID NO: 11749) |
| 58 | +ARGTAAR + RC + ARTATG (SEQ ID NO: 11750) |
| 58 | ARGTAAR + RC + ARTATGA (SEQ ID NO: 11751) |
| 58 | ARGTAAR + RC + ARTAT + G (SEQ ID NO: 11752) |
| 58 | ARGTAAR + RC + ARTA + TG (SEQ ID NO: 11753) |
| 58 | ARGTAAR + RC + AR + TATG (SEQ ID NO: 11754) |
| 58 | AGTAAGACARTATGA (SEQ ID NO: 11755) |
| 58 | AARGTAARRCARTATGAKSA (SEQ ID NO: 11756) |

TABLE 10 -continued

| | |
|---|---|
| 58 | AARGTAARRCARTATGAKS (SEQ ID NO: 11757) |
| 58 | ARGTAARRCARTATGAK (SEQ ID NO: 11758) |
| 58 | ARGTAARRCARTATG (SEQ ID NO: 11759) |
| 71 | G + GRMAWARRGCYATAGGKWC (SEQ ID NO: 11760) |
| 71 | GGRMAW + ARRGCYATAGGKWC (SEQ ID NO: 11761) |
| 71 | GGR + MAWARRGCYATAGGKWC (SEQ ID NO: 11762) |
| 71 | GGRM + AWARRGCYATAGGKWC (SEQ ID NO: 11763) |
| 71 | GGRMAWARRGCYATA + GGKWC (SEQ ID NO: 11764) |
| 71 | GGRMAWARRGCYATAG + GKWC (SEQ ID NO: 11765) |
| 71 | GGRMAWARRG + CYATAGGKWC (SEQ ID NO: 11766) |
| 71 | GGRMAWARRGC + YATAGGKWC (SEQ ID NO: 11767) |
| 71 | G + GRMAWAR + RG + CYATAGGKWC (SEQ ID NO: 11768) |
| 71 | GGRMAWA + R + RG + CYATAGGKWC (SEQ ID NO: 11769) |
| 71 | GG + RMAWAR + RG + CYATAGGKWC (SEQ ID NO: 11770) |
| 71 | GGRMAW + AR + RG + CYATAGGKWC (SEQ ID NO: 11771) |
| 71 | GGRMAWAR + RG + C + YATAGGKWC (SEQ ID NO: 11772) |
| 71 | GGRMAWAR + RG + CYAT + AGGKWC (SEQ ID NO: 11773) |
| 71 | GGRMAWAR + RG + CYATAGG + KWC (SEQ ID NO: 11774) |
| 71 | GGRMAWAR + RG + CYA + TAGGKWC (SEQ ID NO: 11775) |
| 71 | G + GRMAWARRGCYATAGGKW (SEQ ID NO: 11776) |
| 71 | GGRMAW + ARRGCYATAGGKW (SEQ ID NO: 11777) |
| 71 | GGR + MAWARRGCYATAGGKW (SEQ ID NO: 11778) |
| 71 | GGRM + AWARRGCYATAGGKW (SEQ ID NO: 11779) |
| 71 | GGRMAWARRGCYATA + GGKW (SEQ ID NO: 11780) |
| 71 | GGRMAWARRGCYATAG + GKW (SEQ ID NO: 11781) |
| 71 | GGRMAWARRG + CYATAGGKW (SEQ ID NO: 11782) |
| 71 | GGRMAWARRGC + YATAGGKW (SEQ ID NO: 11783) |
| 71 | G + GRMAWAR + RG + CYATAGGKW (SEQ ID NO: 11784) |
| 71 | GGRMAWA + R + RG + CYATAGGKW (SEQ ID NO: 11785) |
| 71 | GG + RMAWAR + RG + CYATAGGKW (SEQ ID NO: 11786) |
| 71 | GGRMAW + AR + RG + CYATAGGKW (SEQ ID NO: 11787) |
| 71 | GGRMAWAR + RG + C + YATAGGKW (SEQ ID NO: 11788) |
| 71 | GGRMAWAR + RG + CYAT + AGGKW (SEQ ID NO: 11789) |
| 71 | GGRMAWAR + RG + CYATAGG + KW (SEQ ID NO: 11790) |
| 71 | GGRMAWAR + RG + CYA + TAGGKW (SEQ ID NO: 11791) |
| 71 | +GRMAWARRGCYATAGGK (SEQ ID NO: 11792) |
| 71 | GRMAW + ARRGCYATAGGK (SEQ ID NO: 11793) |
| 71 | GR + MAWARRGCYATAGGK (SEQ ID NO: 11794) |
| 71 | GRM + AWARRGCYATAGGK (SEQ ID NO: 11795) |
| 71 | GRMAWARRGCYATA + GGK (SEQ ID NO: 11796) |

TABLE 10 -continued

| | |
|---|---|
| 71 | GRMAWARRGCYATAG + GK (SEQ ID NO: 11797) |
| 71 | GRMAWARRG + CYATAGGK (SEQ ID NO: 11798) |
| 71 | GRMAWARRGC + YATAGGK (SEQ ID NO: 11799) |
| 71 | +GRMAWAR + RG + CYATAGGK (SEQ ID NO: 11800) |
| 71 | GRMAWA + R + RG + CYATAGGK (SEQ ID NO: 11801) |
| 71 | G + RMAWAR + RG + CYATAGGK (SEQ ID NO: 11802) |
| 71 | GRMAW + AR + RG + CYATAGGK (SEQ ID NO: 11803) |
| 71 | GRMAWAR + RG + C + YATAGGK (SEQ ID NO: 11804) |
| 71 | GRMAWAR + RG + CYAT + AGGK (SEQ ID NO: 11805) |
| 71 | GRMAWAR + RG + CYATAGG + K (SEQ ID NO: 11806) |
| 71 | GRMAWAR + RG + CYA + TAGGK (SEQ ID NO: 11807) |
| 71 | +GRMAWARRGCYATAG (SEQ ID NO: 11808) |
| 71 | GRMAW + ARRGCYATAG (SEQ ID NO: 11809) |
| 71 | GR + MAWARRGCYATAG (SEQ ID NO: 11810) |
| 71 | GRM + AWARRGCYATAG (SEQ ID NO: 11811) |
| 71 | GRMAWARRGCYATA + G (SEQ ID NO: 11812) |
| 71 | GRMAWARRGCYATAG (SEQ ID NO: 11813) |
| 71 | GRMAWARRG + CYATAG (SEQ ID NO: 11814) |
| 71 | GRMAWARRGC + YATAG (SEQ ID NO: 11815) |
| 71 | +GRMAWAR + RG + CYATAG (SEQ ID NO: 11816) |
| 71 | GRMAWA + R + RG + CYATAG (SEQ ID NO: 11817) |
| 71 | G + RMAWAR + RG + CYATAG (SEQ ID NO: 11818) |
| 71 | GRMAW + AR + RG + CYATAG (SEQ ID NO: 11819) |
| 71 | GRMAWAR + RG + C + YATAG (SEQ ID NO: 11820) |
| 71 | GRMAWAR + RG + CYAT + AG (SEQ ID NO: 11821) |
| 71 | GRMAWAR + RG + CYATAGG (SEQ ID NO: 11822) |
| 71 | GRMAWAR + RG + CYA + TAG (SEQ ID NO: 11823) |
| 71 | CATAAAGCHATAGGT (SEQ ID NO: 11824) |
| 71 | GGRMAWARRGCYATAGGKWC (SEQ ID NO: 11825) |
| 71 | GGRMAWARRGCYATAGGKW (SEQ ID NO: 11826) |
| 71 | GRMAWARRGCYATAGGK (SEQ ID NO: 11827) |
| 71 | GRMAWARRGCYATAG (SEQ ID NO: 11828) |
| 71 | GRMAWARRGCYATAGG (SEQ ID NO: 11829) |
| 73 | RRG + CYATAGGKWCAGTRYTR (SEQ ID NO: 11830) |
| 73 | R + RGCYATAGGKWCAGTRYTR (SEQ ID NO: 11831) |
| 73 | RRGC + YATAGGKWCAGTRYTR (SEQ ID NO: 11832) |
| 73 | RRGCYAT + AGGKWCAGTRYTR (SEQ ID NO: 11833) |
| 73 | RRGCYATAGGKWCAGTRY + TR (SEQ ID NO: 11834) |
| 73 | RRGCYATAGG + KWCAGTRYTR (SEQ ID NO: 11835) |
| 73 | RRGCYATAGGKWC + AGTRYTR (SEQ ID NO: 11836) |

TABLE 10 -continued

| | |
|---|---|
| 73 | RRGCYATAGGK + WCAGTRYTR (SEQ ID NO: 11837) |
| 73 | RRGCYAT + A + GG + KWCAGTRYTR (SEQ ID NO: 11838) |
| 73 | RRGCY + ATA + GG + KWCAGTRYTR (SEQ ID NO: 11839) |
| 73 | RR + GCYATA + GG + KWCAGTRYTR (SEQ ID NO: 11840) |
| 73 | RRG + CYATA + GG + KWCAGTRYTR (SEQ ID NO: 11841) |
| 73 | RRGCYATA + GG + KWC + AGTRYTR (SEQ ID NO: 11842) |
| 73 | RRGCYATA + GG + K + WCAGTRYTR (SEQ ID NO: 11843) |
| 73 | RRGCYATA + GG + KWCAGTR + YTR (SEQ ID NO: 11844) |
| 73 | RRGCYATA + GG + KW + CAGTRYTR (SEQ ID NO: 11845) |
| 73 | ARRGCYA + TAGGKWCAGTRYT (SEQ ID NO: 11846) |
| 73 | A + RRGCYATAGGKWCAGTRYT (SEQ ID NO: 11847) |
| 73 | AR + RGCYATAGGKWCAGTRYT (SEQ ID NO: 11848) |
| 73 | ARRG + CYATAGGKWCAGTRYT (SEQ ID NO: 11849) |
| 73 | ARRGCYATAGGKWC + AGTRYT (SEQ ID NO: 11850) |
| 73 | ARRGCYATAGGK + WCAGTRYT (SEQ ID NO: 11851) |
| 73 | ARRGCYATAGG + KWCAGTRYT (SEQ ID NO: 11852) |
| 73 | ARRGCYATAGGKWCAGTR + YT (SEQ ID NO: 11853) |
| 73 | ARRGCYA + T + AG + GKWCAGTRYT (SEQ ID NO: 11854) |
| 73 | ARRG + CYAT + AG + GKWCAGTRYT (SEQ ID NO: 11855) |
| 73 | A + RRGCYAT + AG + GKWCAGTRYT (SEQ ID NO: 11856) |
| 73 | ARRGCY + AT + AG + GKWCAGTRYT (SEQ ID NO: 11857) |
| 73 | ARRGCYAT + AG + GKWC + AGTRYT (SEQ ID NO: 11858) |
| 73 | ARRGCYAT + AG + GKWCAGTR + YT (SEQ ID NO: 11859) |
| 73 | ARRGCYAT + AG + GKW + CAGTRYT (SEQ ID NO: 11860) |
| 73 | ARRGCYAT + AG + GK + WCAGTRYT (SEQ ID NO: 11861) |
| 73 | RRG + CYATAGGKWCAGTRYT (SEQ ID NO: 11862) |
| 73 | R + RGCYATAGGKWCAGTRYT (SEQ ID NO: 11863) |
| 73 | RRGC + YATAGGKWCAGTRYT (SEQ ID NO: 11864) |
| 73 | RRGCYAT + AGGKWCAGTRYT (SEQ ID NO: 11865) |
| 73 | RRGCYATAGGKWCAGTRY + T (SEQ ID NO: 11866) |
| 73 | RRGCYATAGG + KWCAGTRYT (SEQ ID NO: 11867) |
| 73 | RRGCYATAGGKWC + AGTRYT (SEQ ID NO: 11868) |
| 73 | RRGCYATAGGK + WCAGTRYT (SEQ ID NO: 11869) |
| 73 | RRGCYAT + A + GG + KWCAGTRYT (SEQ ID NO: 11870) |
| 73 | RRGCY + ATA + GG + KWCAGTRYT (SEQ ID NO: 11871) |
| 73 | RR + GCYATA + GG + KWCAGTRYT (SEQ ID NO: 11872) |
| 73 | RRG + CYATA + GG + KWCAGTRYT (SEQ ID NO: 11873) |
| 73 | RRGCYATA + GG + KWC + AGTRYT (SEQ ID NO: 11874) |
| 73 | RRGCYATA + GG + K + WCAGTRYT (SEQ ID NO: 11875) |
| 73 | RRGCYATA + GG + KWCAGTR + YT (SEQ ID NO: 11876) |

TABLE 10 -continued

| | |
|---|---|
| 73 | RRGCYATA + GG + KW + CAGTRYT (SEQ ID NO: 11877) |
| 73 | ARRGCYA + TAGGKWCAGTRY (SEQ ID NO: 11878) |
| 73 | A + RRGCYATAGGKWCAGTRY (SEQ ID NO: 11879) |
| 73 | AR + RGCYATAGGKWCAGTRY (SEQ ID NO: 11880) |
| 73 | ARRG + CYATAGGKWCAGTRY (SEQ ID NO: 11881) |
| 73 | ARRGCYATAGGKWC + AGTRY (SEQ ID NO: 11882) |
| 73 | ARRGCYATAGGK + WCAGTRY (SEQ ID NO: 11883) |
| 73 | ARRGCYATAGG + KWCAGTRY (SEQ ID NO: 11884) |
| 73 | ARRGCYATAGGKWCAGTR + Y (SEQ ID NO: 11885) |
| 73 | ARRGCYA + T + AG + GKWCAGTRY (SEQ ID NO: 11886) |
| 73 | ARRG + CYAT + AG + GKWCAGTRY (SEQ ID NO: 11887) |
| 73 | A + RRGCYAT + AG + GKWCAGTRY (SEQ ID NO: 11888) |
| 73 | ARRGCY + AT + AG + GKWCAGTRY (SEQ ID NO: 11889) |
| 73 | ARRGCYAT + AG + GKWC + AGTRY (SEQ ID NO: 11890) |
| 73 | ARRGCYAT + AG + GKWCAGTR + Y (SEQ ID NO: 11891) |
| 73 | ARRGCYAT + AG + GKW + CAGTRY (SEQ ID NO: 11892) |
| 73 | ARRGCYAT + AG + GK + WCAGTRY (SEQ ID NO: 11893) |
| 73 | RG + CYATAGGKWCAGTRY (SEQ ID NO: 11894) |
| 73 | + RGCYATAGGKWCAGTRY (SEQ ID NO: 11895) |
| 73 | RGC + YATAGGKWCAGTRY (SEQ ID NO: 11896) |
| 73 | RGCYAT + AGGKWCAGTRY (SEQ ID NO: 11897) |
| 73 | RGCYATAGGKWCAGTRY (SEQ ID NO: 11898) |
| 73 | RGCYATAGG + KWCAGTRY (SEQ ID NO: 11899) |
| 73 | RGCYATAGGKWC + AGTRY (SEQ ID NO: 11900) |
| 73 | RGCYATAGGK + WCAGTRY (SEQ ID NO: 11901) |
| 73 | RGCYAT + A + GG + KWCAGTRY (SEQ ID NO: 11902) |
| 73 | RGCY + ATA + GG + KWCAGTRY (SEQ ID NO: 11903) |
| 73 | R + GCYATA + GG + KWCAGTRY (SEQ ID NO: 11904) |
| 73 | RG + CYATA + GG + KWCAGTRY (SEQ ID NO: 11905) |
| 73 | RGCYATA + GG + KWC + AGTRY (SEQ ID NO: 11906) |
| 73 | RGCYATA + GG + K + WCAGTRY (SEQ ID NO: 11907) |
| 73 | RGCYATA + GG + KWCAGTR + Y (SEQ ID NO: 11908) |
| 73 | RGCYATA + GG + KW + CAGTRY (SEQ ID NO: 11909) |
| 73 | RRGCYA + TAGGKWCAGTR (SEQ ID NO: 11910) |
| 73 | +RRGCYATAGGKWCAGTR (SEQ ID NO: 11911) |
| 73 | R + RGCYATAGGKWCAGTR (SEQ ID NO: 11912) |
| 73 | RRG + CYATAGGKWCAGTR (SEQ ID NO: 11913) |
| 73 | RRGCYATAGGKWC + AGTR (SEQ ID NO: 11914) |
| 73 | RRGCYATAGGK + WCAGTR (SEQ ID NO: 11915) |
| 73 | RRGCYATAGG + KWCAGTR (SEQ ID NO: 11916) |

TABLE 10 -continued

| | |
|---|---|
| 73 | RRGCYATAGGKWCAGTR (SEQ ID NO: 11917) |
| 73 | RRGCYA + T + AG + GKWCAGTR (SEQ ID NO: 11918) |
| 73 | RRG + CYAT + AG + GKWCAGTR (SEQ ID NO: 11919) |
| 73 | +RRGCYAT + AG + GKWCAGTR (SEQ ID NO: 11920) |
| 73 | RRGCY + AT + AG + GKWCAGTR (SEQ ID NO: 11921) |
| 73 | RRGCYAT + AG + GKWC + AGTR (SEQ ID NO: 11922) |
| 73 | RRGCYAT + AG + GKWCAGTR (SEQ ID NO: 11923) |
| 73 | RRGCYAT + AG + GKW + CAGTR (SEQ ID NO: 11924) |
| 73 | RRGCYAT + AG + GK + WCAGTR (SEQ ID NO: 11925) |
| 73 | RG + CYATAGGKWCAGT (SEQ ID NO: 11926) |
| 73 | +RGCYATAGGKWCAGT (SEQ ID NO: 11927) |
| 73 | RGC + YATAGGKWCAGT (SEQ ID NO: 11928) |
| 73 | RGCYAT + AGGKWCAGT (SEQ ID NO: 11929) |
| 73 | RGCYATAGGKWCAGTR (SEQ ID NO: 11930) |
| 73 | RGCYATAGG + KWCAGT (SEQ ID NO: 11931) |
| 73 | RGCYATAGGKWC + AGT (SEQ ID NO: 11932) |
| 73 | RGCYATAGGK + WCAGT (SEQ ID NO: 11933) |
| 73 | RGCYAT + A + GG + KWCAGT (SEQ ID NO: 11934) |
| 73 | RGCY + ATA + GG + KWCAGT (SEQ ID NO: 11935) |
| 73 | R + GCYATA + GG + KWCAGT (SEQ ID NO: 11936) |
| 73 | RG + CYATA + GG + KWCAGT (SEQ ID NO: 11937) |
| 73 | RGCYATA + GG + KWC + AGT (SEQ ID NO: 11938) |
| 73 | RGCYATA + GG + K + WCAGT (SEQ ID NO: 11939) |
| 73 | RGCYATA + GG + KWCAGTR (SEQ ID NO: 11940) |
| 73 | RGCYATA + GG + KW + CAGT (SEQ ID NO: 11941) |
| 73 | RRGCYA + TAGGKWCAG (SEQ ID NO: 11942) |
| 73 | +RRGCYATAGGKWCAG (SEQ ID NO: 11943) |
| 73 | R + RGCYATAGGKWCAG (SEQ ID NO: 11944) |
| 73 | RRG + CYATAGGKWCAG (SEQ ID NO: 11945) |
| 73 | RRGCYATAGGKWC + AG (SEQ ID NO: 11946) |
| 73 | RRGCYATAGGK + WCAG (SEQ ID NO: 11947) |
| 73 | RRGCYATAGG + KWCAG (SEQ ID NO: 11948) |
| 73 | RRGCYATAGGKWCAGT (SEQ ID NO: 11949) |
| 73 | RRGCYA + T + AG + GKWCAG (SEQ ID NO: 11950) |
| 73 | RRG + CYAT + AG + GKWCAG (SEQ ID NO: 11951) |
| 73 | +RRGCYAT + AG + GKWCAG (SEQ ID NO: 11952) |
| 73 | RRGCY + AT + AG + GKWCAG (SEQ ID NO: 11953) |
| 73 | RRGCYAT + AG + GKWC + AG (SEQ ID NO: 11954) |
| 73 | RRGCYAT + AG + GKWCAGT (SEQ ID NO: 11955) |
| 73 | RRGCYAT + AG + GKW + CAG (SEQ ID NO: 11956) |

TABLE 10 -continued

| | |
|---|---|
| 73 | RRGCYAT + AG + GK + WCAG (SEQ ID NO: 11957) |
| 73 | TACTGTNCCTATAGC (SEQ ID NO: 11958) |
| 73 | RRGCYATAGGKWCAGTRYTR (SEQ ID NO: 11959) |
| 73 | ARRGCYATAGGKWCAGTRYT (SEQ ID NO: 11960) |
| 73 | RRGCYATAGGKWCAGTRYT (SEQ ID NO: 11961) |
| 73 | ARRGCYATAGGKWCAGTRY (SEQ ID NO: 11962) |
| 73 | RGCYATAGGKWCAGTRY (SEQ ID NO: 11963) |
| 73 | RRGCYATAGGKWCAGTR (SEQ ID NO: 11964) |
| 73 | RGCYATAGGKWCAGT (SEQ ID NO: 11965) |
| 73 | RRGCYATAGGKWCAG (SEQ ID NO: 11966) |
| 74 | GCYATAG + GKACAGTRYTRRT (SEQ ID NO: 11967) |
| 74 | GCY + ATAGGKACAGTRYTRRT (SEQ ID NO: 11968) |
| 74 | GC + YATAGGKACAGTRYTRRT (SEQ ID NO: 11969) |
| 74 | GCYATAGG + KACAGTRYTRRT (SEQ ID NO: 11970) |
| 74 | GCYATAGGKACA + GTRYTRRT (SEQ ID NO: 11971) |
| 74 | GCYATAGGKACAGTRYTR + RT (SEQ ID NO: 11972) |
| 74 | GCYATAGGKA + CAGTRYTRRT (SEQ ID NO: 11973) |
| 74 | GCYATAGGKACAGTRYT + RRT (SEQ ID NO: 11974) |
| 74 | GC + YATAGG + KA + CAGTRYTRRT (SEQ ID NO: 11975) |
| 74 | GCYATA + GG + KA + CAGTRYTRRT (SEQ ID NO: 11976) |
| 74 | GCY + ATAGG + KA + CAGTRYTRRT (SEQ ID NO: 11977) |
| 74 | GCYA + TAGG + KA + CAGTRYTRRT (SEQ ID NO: 11978) |
| 74 | GCYATAGG + KA + CAGTRYTR + RT (SEQ ID NO: 11979) |
| 74 | GCYATAGG + KA + CAG + TRYTRRT (SEQ ID NO: 11980) |
| 74 | GCYATAGG + KA + CAGT + RYTRRT (SEQ ID NO: 11981) |
| 74 | GCYATAGG + KA + C + AGTRYTRRT (SEQ ID NO: 11982) |
| 74 | GCYATAG + GKACAGTRYTRR (SEQ ID NO: 11983) |
| 74 | GCY + ATAGGKACAGTRYTRR (SEQ ID NO: 11984) |
| 74 | GC + YATAGGKACAGTRYTRR (SEQ ID NO: 11985) |
| 74 | GCYATAGG + KACAGTRYTRR (SEQ ID NO: 11986) |
| 74 | GCYATAGGKACA + GTRYTRR (SEQ ID NO: 11987) |
| 74 | GCYATAGGKACAGTRYTR + R (SEQ ID NO: 11988) |
| 74 | GCYATAGGKA + CAGTRYTRR (SEQ ID NO: 11989) |
| 74 | GCYATAGGKACAGTRYT + RR (SEQ ID NO: 11990) |
| 74 | GC + YATAGG + KA + CAGTRYTRR (SEQ ID NO: 11991) |
| 74 | GCYATA + GG + KA + CAGTRYTRR (SEQ ID NO: 11992) |
| 74 | GCY + ATAGG + KA + CAGTRYTRR (SEQ ID NO: 11993) |
| 74 | GCYA + TAGG + KA + CAGTRYTRR (SEQ ID NO: 11994) |
| 74 | GCYATAGG + KA + CAGTRYTR + R (SEQ ID NO: 11995) |
| 74 | GCYATAGG + KA + CAG + TRYTRR (SEQ ID NO: 11996) |

TABLE 10 -continued

| | | |
|---|---|---|
| 74 | GCYATAGG + KA + CAGT + RYTRR | (SEQ ID NO: 11997) |
| 74 | GCYATAGG + KA + C + AGTRYTRR | (SEQ ID NO: 11998) |
| 74 | CYATAG + GKACAGTRYTR | (SEQ ID NO: 11999) |
| 74 | CY + ATAGGKACAGTRYTR | (SEQ ID NO: 12000) |
| 74 | C + YATAGGKACAGTRYTR | (SEQ ID NO: 12001) |
| 74 | CYATAGG + KACAGTRYTR | (SEQ ID NO: 12002) |
| 74 | CYATAGGKACA + GTRYTR | (SEQ ID NO: 12003) |
| 74 | CYATAGGKACAGTRYTR | (SEQ ID NO: 12004) |
| 74 | CYATAGGKA + CAGTRYTR | (SEQ ID NO: 12005) |
| 74 | CYATAGGKACAGTRYT + R | (SEQ ID NO: 12006) |
| 74 | C + YATAGG + KA + CAGTRYTR | (SEQ ID NO: 12007) |
| 74 | CYATA + GG + KA + CAGTRYTR | (SEQ ID NO: 12008) |
| 74 | CY + ATAGG + KA + CAGTRYTR | (SEQ ID NO: 12009) |
| 74 | CYA + TAGG + KA + CAGTRYTR | (SEQ ID NO: 12010) |
| 74 | CYATAGG + KA + CAGTRYTR | (SEQ ID NO: 12011) |
| 74 | CYATAGG + KA + CAG + TRYTR | (SEQ ID NO: 12012) |
| 74 | CYATAGG + KA + CAGT + RYTR | (SEQ ID NO: 12013) |
| 74 | CYATAGG + KA + C + AGTRYTR | (SEQ ID NO: 12014) |
| 74 | CYATAG + GKACAGTRY | (SEQ ID NO: 12015) |
| 74 | CY + ATAGGKACAGTRY | (SEQ ID NO: 12016) |
| 74 | C + YATAGGKACAGTRY | (SEQ ID NO: 12017) |
| 74 | CYATAGG + KACAGTRY | (SEQ ID NO: 12018) |
| 74 | CYATAGGKACA + GTRY | (SEQ ID NO: 12019) |
| 74 | CYATAGGKACAGTRYT | (SEQ ID NO: 12020) |
| 74 | CYATAGGKA + CAGTRY | (SEQ ID NO: 12021) |
| 74 | C + YATAGG + KA + CAGTRY | (SEQ ID NO: 12022) |
| 74 | CYATA + GG + KA + CAGTRY | (SEQ ID NO: 12023) |
| 74 | CY + ATAGG + KA + CAGTRY | (SEQ ID NO: 12024) |
| 74 | CYA + TAGG + KA + CAGTRY | (SEQ ID NO: 12025) |
| 74 | CYATAGG + KA + CAGTRYT | (SEQ ID NO: 12026) |
| 74 | CYATAGG + KA + CAG + TRY | (SEQ ID NO: 12027) |
| 74 | CYATAGG + KA + CAGT + RY | (SEQ ID NO: 12028) |
| 74 | CYATAGG + KA + C + AGTRY | (SEQ ID NO: 12029) |
| 74 | ATAGGTACRGTATTA | (SEQ ID NO: 12030) |
| 74 | GCYATAGGKACAGTRYTRRT | (SEQ ID NO: 12031) |
| 74 | GCYATAGGKACAGTRYTRR | (SEQ ID NO: 12032) |
| 74 | CYATAGGKACAGTRYTR | (SEQ ID NO: 12033) |
| 74 | CYATAGGKACAGTRY | (SEQ ID NO: 12034) |
| 76 | GGKWCA + GTRYTRRTRGGRCC | (SEQ ID NO: 12035) |
| 76 | GGK + WCAGTRYTRRTRGGRCC | (SEQ ID NO: 12036) |

TABLE 10 -continued

| 76 | GGKWCAGT + RYTRRTRGGRCC (SEQ ID NO: 12037) |
| 76 | G + GKWCAGTRYTRRTRGGRCC (SEQ ID NO: 12038) |
| 76 | GGKWCAGTRYTRRTRGGR + CC (SEQ ID NO: 12039) |
| 76 | GGKWCAGTRYTRRT + RGGRCC (SEQ ID NO: 12040) |
| 76 | GGKWCAGTRYTR + RTGGRCC (SEQ ID NO: 12041) |
| 76 | GGKWCAGTRY + TRRTRGGRCC (SEQ ID NO: 12042) |
| 76 | GGKW + CAGT + RY + TRRTRGGRCC (SEQ ID NO: 12043) |
| 76 | GG + KWCAGT + RY + TRRTRGGRCC (SEQ ID NO: 12044) |
| 76 | GGKWC + AGT + RY + TRRTRGGRCC (SEQ ID NO: 12045) |
| 76 | G + GKWCAGT + RY + TRRTRGGRCC (SEQ ID NO: 12046) |
| 76 | GGKWCAGT + RY + T + RRTRGGRCC (SEQ ID NO: 12047) |
| 76 | GGKWCAGT + RY + TRR + TRGGRCC (SEQ ID NO: 12048) |
| 76 | GGKWCAGT + RY + TRRT + RGGRCC (SEQ ID NO: 12049) |
| 76 | GGKWCAGT + RY + TRRTR + GGRCC (SEQ ID NO: 12050) |
| 76 | GGKWCA + GTRYTRRTRGGRC (SEQ ID NO: 12051) |
| 76 | GGK + WCAGTRYTRRTRGGRC (SEQ ID NO: 12052) |
| 76 | GGKWCAGT + RYTRRTRGGRC (SEQ ID NO: 12053) |
| 76 | G + GKWCAGTRYTRRTRGGRC (SEQ ID NO: 12054) |
| 76 | GGKWCAGTRYTRRTRGGR + C (SEQ ID NO: 12055) |
| 76 | GGKWCAGTRYTRRT + RGGRC (SEQ ID NO: 12056) |
| 76 | GGKWCAGTRYTR + RTGGRC (SEQ ID NO: 12057) |
| 76 | GGKWCAGTRY + TRRTRGGRC (SEQ ID NO: 12058) |
| 76 | GGKW + CAGT + RY + TRRTRGGRC (SEQ ID NO: 12059) |
| 76 | GG + KWCAGT + RY + TRRTRGGRC (SEQ ID NO: 12060) |
| 76 | GGKWC + AGT + RY + TRRTRGGRC (SEQ ID NO: 12061) |
| 76 | G + GKWCAGT + RY + TRRTRGGRC (SEQ ID NO: 12062) |
| 76 | GGKWCAGT + RY + T + RRTRGGRC (SEQ ID NO: 12063) |
| 76 | GGKWCAGT + RY + TRR + TRGGRC (SEQ ID NO: 12064) |
| 76 | GGKWCAGT + RY + TRRT + RGGRC (SEQ ID NO: 12065) |
| 76 | GGKWCAGT + RY + TRRTR + GGRC (SEQ ID NO: 12066) |
| 76 | GKWCA + GTRYTRRTRGGR (SEQ ID NO: 12067) |
| 76 | GK + WCAGTRYTRRTRGGR (SEQ ID NO: 12068) |
| 76 | GKWCAGT + RYTRRTRGGR (SEQ ID NO: 12069) |
| 76 | +GKWCAGTRYTRRTRGGR (SEQ ID NO: 12070) |
| 76 | GKWCAGTRYTRRTRGGR (SEQ ID NO: 12071) |
| 76 | GKWCAGTRYTRRT + RGGR (SEQ ID NO: 12072) |
| 76 | GKWCAGTRYTR + RTGGR (SEQ ID NO: 12073) |
| 76 | GKWCAGTRY + TRRTRGGR (SEQ ID NO: 12074) |
| 76 | GKW + CAGT + RY + TRRTRGGR (SEQ ID NO: 12075) |
| 76 | G + KWCAGT + RY + TRRTRGGR (SEQ ID NO: 12076) |

TABLE 10 -continued

| | |
|---|---|
| 76 | GKWC + AGT + RY + TRRTRGGR (SEQ ID NO: 12077) |
| 76 | +GKWCAGT + RY + TRRTRGGR (SEQ ID NO: 12078) |
| 76 | GKWCAGT + RY + T + RRTRGGR (SEQ ID NO: 12079) |
| 76 | GKWCAGT + RY + TRR + TRGGR (SEQ ID NO: 12080) |
| 76 | GKWCAGT + RY + TRRT + RGGR (SEQ ID NO: 12081) |
| 76 | GKWCAGT + RY + TRRTR + GGR (SEQ ID NO: 12082) |
| 76 | GKWCA + GTRYTRRTRG (SEQ ID NO: 12083) |
| 76 | GK + WCAGTRYTRRTRG (SEQ ID NO: 12084) |
| 76 | GKWCAGT + RYTRRTRG (SEQ ID NO: 12085) |
| 76 | +GKWCAGTRYTRRTRG (SEQ ID NO: 12086) |
| 76 | GKWCAGTRYTRRTRGG (SEQ ID NO: 12087) |
| 76 | GKWCAGTRYTRRT + RG (SEQ ID NO: 12088) |
| 76 | GKWCAGTRYTR + RTRG (SEQ ID NO: 12089) |
| 76 | GKWCAGTRY + TRRTRG (SEQ ID NO: 12090) |
| 76 | GKW + CAGT + RY + TRRTRG (SEQ ID NO: 12091) |
| 76 | G + KWCAGT + RY + TRRTRG (SEQ ID NO: 12092) |
| 76 | GKWC + AGT + RY + TRRTRG (SEQ ID NO: 12093) |
| 76 | +GKWCAGT + RY + TRRTRG (SEQ ID NO: 12094) |
| 76 | GKWCAGT + RY + T + RRTRG (SEQ ID NO: 12095) |
| 76 | GKWCAGT + RY + TRR + TRG (SEQ ID NO: 12096) |
| 76 | GKWCAGT + RY + TRRT + RG (SEQ ID NO: 12097) |
| 76 | GKWCAGT + RY + TRRTR + G (SEQ ID NO: 12098) |
| 76 | ACAGTAYTRGTAGGA (SEQ ID NO: 12099) |
| 76 | GGKWCAGTRYTRRTRGGRCC (SEQ ID NO: 12100) |
| 76 | GGKWCAGTRYTRRTRGGRC (SEQ ID NO: 12101) |
| 76 | GKWCAGTRYTRRTRGGR (SEQ ID NO: 12102) |
| 76 | GKWCAGTRYTRRTRG (SEQ ID NO: 12103) |
| 82 | CYACA + CCTRTCAACATAATT (SEQ ID NO: 12104) |
| 82 | CYA + CACCTRTCAACATAATT (SEQ ID NO: 12105) |
| 82 | CYACAC + CTRTCAACATAATT (SEQ ID NO: 12106) |
| 82 | CYACACCT + RTCAACATAATT (SEQ ID NO: 12107) |
| 82 | CYACACCTRTCAACAT + AATT (SEQ ID NO: 12108) |
| 82 | CYACACCTRTCAACA + TAATT (SEQ ID NO: 12109) |
| 82 | CYACACCTRTCAACATAA + TT (SEQ ID NO: 12110) |
| 82 | CYACACCTRTCA + ACATAATT (SEQ ID NO: 12111) |
| 82 | CYAC + ACCT + RT + CAACATAATT (SEQ ID NO: 12112) |
| 82 | CYA + CACCT + RT + CAACATAATT (SEQ ID NO: 12113) |
| 82 | CYACACC + T + RT + CAACATAATT (SEQ ID NO: 12114) |
| 82 | C + YACACCT + RT + CAACATAATT (SEQ ID NO: 12115) |
| 82 | CYACACCT + RT + CAAC + ATAATT (SEQ ID NO: 12116) |

TABLE 10 -continued

| | | |
|---|---|---|
| 82 | CYACACCT + RT + CAACATAA + TT | (SEQ ID NO: 12117) |
| 82 | CYACACCT + RT + CAACA + TAATT | (SEQ ID NO: 12118) |
| 82 | CYACACCT + RT + CAA + CATAATT | (SEQ ID NO: 12119) |
| 82 | CCYA + CACCTGTCAACATAAT | (SEQ ID NO: 12120) |
| 82 | CCYACACC + TGTCAACATAAT | (SEQ ID NO: 12121) |
| 82 | CC + YACACCTGTCAACATAAT | (SEQ ID NO: 12122) |
| 82 | CCYACAC + CTGTCAACATAAT | (SEQ ID NO: 12123) |
| 82 | CCYACACCTGTCAA + CATAAT | (SEQ ID NO: 12124) |
| 82 | CCYACACCTGTCAAC + ATAAT | (SEQ ID NO: 12125) |
| 82 | CCYACACCTGTCAACA + TAAT | (SEQ ID NO: 12126) |
| 82 | CCYACACCTGTC + AACATAAT | (SEQ ID NO: 12127) |
| 82 | CCY + ACACC + TG + TCAACATAAT | (SEQ ID NO: 12128) |
| 82 | CC + YACACC + TG + TCAACATAAT | (SEQ ID NO: 12129) |
| 82 | C + CYACACC + TG + TCAACATAAT | (SEQ ID NO: 12130) |
| 82 | CCYACAC + C + TG + TCAACATAAT | (SEQ ID NO: 12131) |
| 82 | CCYACACC + TG + TC + AACATAAT | (SEQ ID NO: 12132) |
| 82 | CCYACACC + TG + TCAAC + ATAAT | (SEQ ID NO: 12133) |
| 82 | CCYACACC + TG + TCA + ACATAAT | (SEQ ID NO: 12134) |
| 82 | CCYACACC + TG + TCAACAT + AAT | (SEQ ID NO: 12135) |
| 82 | CYACA + CCTRTCAACATAAT | (SEQ ID NO: 12136) |
| 82 | CYA + CACCTRTCAACATAAT | (SEQ ID NO: 12137) |
| 82 | CYACAC + CTRTCAACATAAT | (SEQ ID NO: 12138) |
| 82 | CYACACCT + RTCAACATAAT | (SEQ ID NO: 12139) |
| 82 | CYACACCTRTCAACAT + AAT | (SEQ ID NO: 12140) |
| 82 | CYACACCTRTCAACA + TAAT | (SEQ ID NO: 12141) |
| 82 | CYACACCTRTCAACATAA + T | (SEQ ID NO: 12142) |
| 82 | CYACACCTRTCA + ACATAAT | (SEQ ID NO: 12143) |
| 82 | CYAC + ACCT + RT + CAACATAAT | (SEQ ID NO: 12144) |
| 82 | CYA + CACCT + RT + CAACATAAT | (SEQ ID NO: 12145) |
| 82 | CYACACC + T + RT + CAACATAAT | (SEQ ID NO: 12146) |
| 82 | C + YACACCT + RT + CAACATAAT | (SEQ ID NO: 12147) |
| 82 | CYACACCT + RT + CAAC + ATAAT | (SEQ ID NO: 12148) |
| 82 | CYACACCT + RT + CAACATAA + T | (SEQ ID NO: 12149) |
| 82 | CYACACCT + RT + CAACA + TAAT | (SEQ ID NO: 12150) |
| 82 | CYACACCT + RT + CAA + CATAAT | (SEQ ID NO: 12151) |
| 82 | CCYA + CACCTGTCAACATAA | (SEQ ID NO: 12152) |
| 82 | CCYACACC + TGTCAACATAA | (SEQ ID NO: 12153) |
| 82 | CC + YACACCTGTCAACATAA | (SEQ ID NO: 12154) |
| 82 | CCYACAC + CTGTCAACATAA | (SEQ ID NO: 12155) |
| 82 | CCYACACCTGTCAA + CATAA | (SEQ ID NO: 12156) |

| | | |
|---|---|---|
| 82 | CCYACACCTGTCAAC + ATAA | (SEQ ID NO: 12157) |
| 82 | CCYACACCTGTCAACA + TAA | (SEQ ID NO: 12158) |
| 82 | CCYACACCTGTC + AACATAA | (SEQ ID NO: 12159) |
| 82 | CCY + ACACC + TG + TCAACATAA | (SEQ ID NO: 12160) |
| 82 | CC + YACACC + TG + TCAACATAA | (SEQ ID NO: 12161) |
| 82 | C + CYACACC + TG + TCAACATAA | (SEQ ID NO: 12162) |
| 82 | CCYACAC + C + TG + TCAACATAA | (SEQ ID NO: 12163) |
| 82 | CCYACACC + TG + TC + AACATAA | (SEQ ID NO: 12164) |
| 82 | CCYACACC + TG + TCAAC + ATAA | (SEQ ID NO: 12165) |
| 82 | CCYACACC + TG + TCA + ACATAA | (SEQ ID NO: 12166) |
| 82 | CCYACACC + TG + TCAACAT + AA | (SEQ ID NO: 12167) |
| 82 | YACA + CCTRTCAACATAA | (SEQ ID NO: 12168) |
| 82 | YA + CACCTRTCAACATAA | (SEQ ID NO: 12169) |
| 82 | YACAC + CTRTCAACATAA | (SEQ ID NO: 12170) |
| 82 | YACACCT + RTCAACATAA | (SEQ ID NO: 12171) |
| 82 | YACACCTRTCAACAT + AA | (SEQ ID NO: 12172) |
| 82 | YACACCTRTCAACA + TAA | (SEQ ID NO: 12173) |
| 82 | YACACCTRTCAACATAA | (SEQ ID NO: 12174) |
| 82 | YACACCTRTCA + ACATAA | (SEQ ID NO: 12175) |
| 82 | YAC + ACCT + RT + CAACATAA | (SEQ ID NO: 12176) |
| 82 | YA + CACCT + RT + CAACATAA | (SEQ ID NO: 12177) |
| 82 | YACACC + T + RT + CAACATAA | (SEQ ID NO: 12178) |
| 82 | +YACACCT + RT + CAACATAA | (SEQ ID NO: 12179) |
| 82 | YACACCT + RT + CAAC + ATAA | (SEQ ID NO: 12180) |
| 82 | YACACCT + RT + CAACATAA | (SEQ ID NO: 12181) |
| 82 | YACACCT + RT + CAACA + TAA | (SEQ ID NO: 12182) |
| 82 | YACACCT + RT + CAA + CATAA | (SEQ ID NO: 12183) |
| 82 | CYA + CACCTGTCAACATA | (SEQ ID NO: 12184) |
| 82 | CYACACC + TGTCAACATA | (SEQ ID NO: 12185) |
| 82 | C + YACACCTGTCAACATA | (SEQ ID NO: 12186) |
| 82 | CYACAC + CTGTCAACATA | (SEQ ID NO: 12187) |
| 82 | CYACACCTGTCAA + CATA | (SEQ ID NO: 12188) |
| 82 | CYACACCTGTCAAC + ATA | (SEQ ID NO: 12189) |
| 82 | CYACACCTGTCAACA + TA | (SEQ ID NO: 12190) |
| 82 | CYACACCTGTC + AACATA | (SEQ ID NO: 12191) |
| 82 | CY + ACACC + TG + TCAACATA | (SEQ ID NO: 12192) |
| 82 | C + YACACC + TG + TCAACATA | (SEQ ID NO: 12193) |
| 82 | +CYACACC + TG + TCAACATA | (SEQ ID NO: 12194) |
| 82 | CYACAC + C + TG + TCAACATA | (SEQ ID NO: 12195) |
| 82 | CYACACC + TG + TC + AACATA | (SEQ ID NO: 12196) |

TABLE 10 -continued

| | |
|---|---|
| 82 | CYACACC + TG + TCAAC + ATA (SEQ ID NO: 12197) |
| 82 | CYACACC + TG + TCA + ACATA (SEQ ID NO: 12198) |
| 82 | CYACACC + TG + TCAACAT + A (SEQ ID NO: 12199) |
| 82 | YACA + CCTRTCAACAT (SEQ ID NO: 12200) |
| 82 | YA + CACCTRTCAACAT (SEQ ID NO: 12201) |
| 82 | YACAC + CTRTCAACAT (SEQ ID NO: 12202) |
| 82 | YACACCT + RTCAACAT (SEQ ID NO: 12203) |
| 82 | YACACCTRTCAACAT (SEQ ID NO: 12204) |
| 82 | YACACCTRTCAACA + T (SEQ ID NO: 12205) |
| 82 | YACACCTRTCAACATA (SEQ ID NO: 12206) |
| 82 | YACACCTRTCA + ACAT (SEQ ID NO: 12207) |
| 82 | YAC + ACCT + RT + CAACAT (SEQ ID NO: 12208) |
| 82 | YA + CACCT + RT + CAACAT (SEQ ID NO: 12209) |
| 82 | YACACC + T + RT + CAACAT (SEQ ID NO: 12210) |
| 82 | +YACACCT + RT + CAACAT (SEQ ID NO: 12211) |
| 82 | YACACCT + RT + CAAC + AT (SEQ ID NO: 12212) |
| 82 | YACACCT + RT + CAACATA (SEQ ID NO: 12213) |
| 82 | YACACCT + RT + CAACA + T (SEQ ID NO: 12214) |
| 82 | YACACCT + RT + CAA + CAT (SEQ ID NO: 12215) |
| 82 | CYA + CACCTGTCAACA (SEQ ID NO: 12216) |
| 82 | CYACACC + TGTCAACA (SEQ ID NO: 12217) |
| 82 | C + YACACCTGTCAACA (SEQ ID NO: 12218) |
| 82 | CYACAC + CTGTCAACA (SEQ ID NO: 12219) |
| 82 | CYACACCTGTCAA + CA (SEQ ID NO: 12220) |
| 82 | CYACACCTGTCAAC + A (SEQ ID NO: 12221) |
| 82 | CYACACCTGTCAACA (SEQ ID NO: 12222) |
| 82 | CYACACCTGTC + AACA (SEQ ID NO: 12223) |
| 82 | CY + ACACC + TG + TCAACA (SEQ ID NO: 12224) |
| 82 | C + YACACC + TG + TCAACA (SEQ ID NO: 12225) |
| 82 | +CYACACC + TG + TCAACA (SEQ ID NO: 12226) |
| 82 | CYACAC + C + TG + TCAACA (SEQ ID NO: 12227) |
| 82 | CYACACC + TG + TC + AACA (SEQ ID NO: 12228) |
| 82 | CYACACC + TG + TCAAC + A (SEQ ID NO: 12229) |
| 82 | CYACACC + TG + TCA + ACA (SEQ ID NO: 12230) |
| 82 | CYACACC + TG + TCAACAT (SEQ ID NO: 12231) |
| 82 | ACACCTGTYAACATA (SEQ ID NO: 12232) |
| 82 | CYACACCTRTCAACATAATT (SEQ ID NO: 12233) |
| 82 | CCYACACCTGTCAACATAAT (SEQ ID NO: 12234) |
| 82 | CYACACCTRTCAACATAAT (SEQ ID NO: 12235) |
| 82 | CCYACACCTGTCAACATAA (SEQ ID NO: 12236) |

TABLE 10 -continued

| | |
|---|---|
| 82 | YACACCTRTCAACATAA (SEQ ID NO: 12237) |
| 82 | CYACACCTGTCAACATA (SEQ ID NO: 12238) |
| 82 | YACACCTRTCAACAT (SEQ ID NO: 12239) |
| 82 | CYACACCTGTCAACA (SEQ ID NO: 12240) |
| 82 | CYACACCTGTCAACAT (SEQ ID NO: 12241) |
| 83 | ACAC + CTRTCAACATAATTGG (SEQ ID NO: 12242) |
| 83 | AC + ACCTRTCAACATAATTGG (SEQ ID NO: 12243) |
| 83 | ACACC + TRTCAACATAATTGG (SEQ ID NO: 12244) |
| 83 | ACACCTRT + CAACATAATTGG (SEQ ID NO: 12245) |
| 83 | ACACCTRTCAACATA + ATTGG (SEQ ID NO: 12246) |
| 83 | ACACCTRTCAACATAA + TTGG (SEQ ID NO: 12247) |
| 83 | ACACCTRTCAA + CATAATTGG (SEQ ID NO: 12248) |
| 83 | ACACCTRTCAACAT + AATTGG (SEQ ID NO: 12249) |
| 83 | AC + ACCTRT + CA + ACATAATTGG (SEQ ID NO: 12250) |
| 83 | ACACCT + RT + CA + ACATAATTGG (SEQ ID NO: 12251) |
| 83 | A + CACCTRT + CA + ACATAATTGG (SEQ ID NO: 12252) |
| 83 | ACACC + TRT + CA + ACATAATTGG (SEQ ID NO: 12253) |
| 83 | ACACCTRT + CA + ACATAAT + TGG (SEQ ID NO: 12254) |
| 83 | ACACCTRT + CA + ACA + TAATTGG (SEQ ID NO: 12255) |
| 83 | ACACCTRT + CA + ACATAATT + GG (SEQ ID NO: 12256) |
| 83 | ACACCTRT + CA + A + CATAATTGG (SEQ ID NO: 12257) |
| 83 | ACAC + CTRTCAACATAATTG (SEQ ID NO: 12258) |
| 83 | AC + ACCTRTCAACATAATTG (SEQ ID NO: 12259) |
| 83 | ACACC + TRTCAACATAATTG (SEQ ID NO: 12260) |
| 83 | ACACCTRT + CAACATAATTG (SEQ ID NO: 12261) |
| 83 | ACACCTRTCAACATA + ATTG (SEQ ID NO: 12262) |
| 83 | ACACCTRTCAACATAA + TTG (SEQ ID NO: 12263) |
| 83 | ACACCTRTCAA + CATAATTG (SEQ ID NO: 12264) |
| 83 | ACACCTRTCAACAT + AATTG (SEQ ID NO: 12265) |
| 83 | AC + ACCTRT + CA + ACATAATTG (SEQ ID NO: 12266) |
| 83 | ACACCT + RT + CA + ACATAATTG (SEQ ID NO: 12267) |
| 83 | A + CACCTRT + CA + ACATAATTG (SEQ ID NO: 12268) |
| 83 | ACACC + TRT + CA + ACATAATTG (SEQ ID NO: 12269) |
| 83 | ACACCTRT + CA + ACATAAT + TG (SEQ ID NO: 12270) |
| 83 | ACACCTRT + CA + ACA + TAATTG (SEQ ID NO: 12271) |
| 83 | ACACCTRT + CA + ACATAATT + G (SEQ ID NO: 12272) |
| 83 | ACACCTRT + CA + A + CATAATTG (SEQ ID NO: 12273) |
| 83 | CAC + CTRTCAACATAATT (SEQ ID NO: 12274) |
| 83 | C + ACCTRTCAACATAATT (SEQ ID NO: 12275) |
| 83 | CACC + TRTCAACATAATT (SEQ ID NO: 12276) |

| | TABLE 10 -continued | |
|---|---|---|
| 83 | CACCTRT + CAACATAATT (SEQ ID NO: 12277) | |
| 83 | CACCTRTCAACATA + ATT (SEQ ID NO: 12278) | |
| 83 | CACCTRTCAACATAA + TT (SEQ ID NO: 12279) | |
| 83 | CACCTRTCAA + CATAATT (SEQ ID NO: 12280) | |
| 83 | CACCTRTCAACAT + AATT (SEQ ID NO: 12281) | |
| 83 | C + ACCTRT + CA + ACATAATT (SEQ ID NO: 12282) | |
| 83 | CACCT + RT + CA + ACATAATT (SEQ ID NO: 12283) | |
| 83 | +CACCTRT + CA + ACATAATT (SEQ ID NO: 12284) | |
| 83 | CACC + TRT + CA + ACATAATT (SEQ ID NO: 12285) | |
| 83 | CACCTRT + CA + ACATAAT + T (SEQ ID NO: 12286) | |
| 83 | CACCTRT + CA + ACA + TAATT (SEQ ID NO: 12287) | |
| 83 | CACCTRT + CA + ACATAATT (SEQ ID NO: 12288) | |
| 83 | CACCTRT + CA + A + CATAATT (SEQ ID NO: 12289) | |
| 83 | CAC + CTRTCAACATAA (SEQ ID NO: 12290) | |
| 83 | C + ACCTRTCAACATAA (SEQ ID NO: 12291) | |
| 83 | CACC + TRTCAACATAA (SEQ ID NO: 12292) | |
| 83 | CACCTRT + CAACATAA (SEQ ID NO: 12293) | |
| 83 | CACCTRTCAACATA + A (SEQ ID NO: 12294) | |
| 83 | CACCTRTCAACATAA (SEQ ID NO: 12295) | |
| 83 | CACCTRTCAA + CATAA (SEQ ID NO: 12296) | |
| 83 | CACCTRTCAACAT + AA (SEQ ID NO: 12297) | |
| 83 | C + ACCTRT + CA + ACATAA (SEQ ID NO: 12298) | |
| 83 | CACCT + RT + CA + ACATAA (SEQ ID NO: 12299) | |
| 83 | +CACCTRT + CA + ACATAA (SEQ ID NO: 12300) | |
| 83 | CACC + TRT + CA + ACATAA (SEQ ID NO: 12301) | |
| 83 | CACCTRT + CA + ACATAAT (SEQ ID NO: 12302) | |
| 83 | CACCTRT + CA + ACA + TAA (SEQ ID NO: 12303) | |
| 83 | CACCTRT + CA + A + CATAA (SEQ ID NO: 12304) | |
| 83 | ACCTGTCAAYATAAT (SEQ ID NO: 12305) | |
| 83 | ACACCTRTCAACATAATTGG (SEQ ID NO: 12306) | |
| 83 | ACACCTRTCAACATAATTG (SEQ ID NO: 12307) | |
| 83 | CACCTRTCAACATAATT (SEQ ID NO: 12308) | |
| 83 | CACCTRTCAACATAA (SEQ ID NO: 12309) | |
| 83 | CACCTRTCAACATAAT (SEQ ID NO: 12310) | |
| 84 | C + CTRTCAACATAATTGGRMG (SEQ ID NO: 12311) | |
| 84 | CC + TRTCAACATAATTGGRMG (SEQ ID NO: 12312) | |
| 84 | CCTRTCAA + CATAATTGGRMG (SEQ ID NO: 12313) | |
| 84 | CCTR + TCAACATAATTGGRMG (SEQ ID NO: 12314) | |
| 84 | CCTRTCAACATAAT + TGGRMG (SEQ ID NO: 12315) | |
| 84 | CCTRTCAACATAATTGGR + MG (SEQ ID NO: 12316) | |

TABLE 10 -continued

| 84 | CCTRTCAACAT + AATTGGRMG (SEQ ID NO: 12317) |
| 84 | CCTRTCAACATA + ATTGGRMG (SEQ ID NO: 12318) |
| 84 | CCTRTC + AA + CA + TAATTGGRMG (SEQ ID NO: 12319) |
| 84 | CCTRT + CAA + CA + TAATTGGRMG (SEQ ID NO: 12320) |
| 84 | CC + TRTCAA + CA + TAATTGGRMG (SEQ ID NO: 12321) |
| 84 | CCTR + TCAA + CA + TAATTGGRMG (SEQ ID NO: 12322) |
| 84 | CCTRTCAA + CA + TAATTG + GRMG (SEQ ID NO: 12323) |
| 84 | CCTRTCAA + CA + T + AATTGGRMG (SEQ ID NO: 12324) |
| 84 | CCTRTCAA + CA + TAAT + TGGRMG (SEQ ID NO: 12325) |
| 84 | CCTRTCAA + CA + TAATTGGR + MG (SEQ ID NO: 12326) |
| 84 | C + CTRTCAACATAATTGGRM (SEQ ID NO: 12327) |
| 84 | CC + TRTCAACATAATTGGRM (SEQ ID NO: 12328) |
| 84 | CCTRTCAA + CATAATTGGRM (SEQ ID NO: 12329) |
| 84 | CCTR + TCAACATAATTGGRM (SEQ ID NO: 12330) |
| 84 | CCTRTCAACATAAT + TGGRM (SEQ ID NO: 12331) |
| 84 | CCTRTCAACATAATTGGR + M (SEQ ID NO: 12332) |
| 84 | CCTRTCAACAT + AATTGGRM (SEQ ID NO: 12333) |
| 84 | CCTRTCAACATA + ATTGGRM (SEQ ID NO: 12334) |
| 84 | CCTRTC + AA + CA + TAATTGGRM (SEQ ID NO: 12335) |
| 84 | CCTRT + CAA + CA + TAATTGGRM (SEQ ID NO: 12336) |
| 84 | CC + TRTCAA + CA + TAATTGGRM (SEQ ID NO: 12337) |
| 84 | CCTR + TCAA + CA + TAATTGGRM (SEQ ID NO: 12338) |
| 84 | CCTRTCAA + CA + TAATTG + GRM (SEQ ID NO: 12339) |
| 84 | CCTRTCAA + CA + T + AATTGGRM (SEQ ID NO: 12340) |
| 84 | CCTRTCAA + CA + TAAT + TGGRM (SEQ ID NO: 12341) |
| 84 | CCTRTCAA + CA + TAATTGGR + M (SEQ ID NO: 12342) |
| 84 | +CTRTCAACATAATTGGR (SEQ ID NO: 12343) |
| 84 | C + TRTCAACATAATTGGR (SEQ ID NO: 12344) |
| 84 | CTRTCAA + CATAATTGGR (SEQ ID NO: 12345) |
| 84 | CTR + TCAACATAATTGGR (SEQ ID NO: 12346) |
| 84 | CTRTCAACATAAT + TGGR (SEQ ID NO: 12347) |
| 84 | CTRTCAACATAATTGGR (SEQ ID NO: 12348) |
| 84 | CTRTCAACAT + AATTGGR (SEQ ID NO: 12349) |
| 84 | CTRTCAACATA + ATTGGR (SEQ ID NO: 12350) |
| 84 | CTRTC + AA + CA + TAATTGGR (SEQ ID NO: 12351) |
| 84 | CTRT + CAA + CA + TAATTGGR (SEQ ID NO: 12352) |
| 84 | C + TRTCAA + CA + TAATTGGR (SEQ ID NO: 12353) |
| 84 | CTR + TCAA + CA + TAATTGGR (SEQ ID NO: 12354) |
| 84 | CTRTCAA + CA + TAATTG + GR (SEQ ID NO: 12355) |
| 84 | CTRTCAA + CA + T + AATTGGR (SEQ ID NO: 12356) |

TABLE 10 -continued

| | | |
|---|---|---|
| 84 | CTRTCAA + CA + TAAT + TGGR (SEQ ID NO:1 2357) | |
| 84 | CTRTCAA + CA + TAATTGGR (SEQ ID NO: 12358) | |
| 84 | +CTRTCAACATAATTG (SEQ ID NO: 12359) | |
| 84 | C + TRTCAACATAATTG (SEQ ID NO: 12360) | |
| 84 | CTRTCAA + CATAATTG (SEQ ID NO: 12361) | |
| 84 | CTR + TCAACATAATTG (SEQ ID NO: 12362) | |
| 84 | CTRTCAACATAAT + TG (SEQ ID NO: 12363) | |
| 84 | CTRTCAACATAATTGG (SEQ ID NO: 12364) | |
| 84 | CTRTCAACAT + AATTG (SEQ ID NO: 12365) | |
| 84 | CTRTCAACATA + ATTG (SEQ ID NO: 12366) | |
| 84 | CTRTC + AA + CA + TAATTG (SEQ ID NO: 12367) | |
| 84 | CTRT + CAA + CA + TAATTG (SEQ ID NO: 12368) | |
| 84 | C + TRTCAA + CA + TAATTG (SEQ ID NO: 12369) | |
| 84 | CTR + TCAA + CA + TAATTG (SEQ ID NO: 12370) | |
| 84 | CTRTCAA + CA + TAATTG (SEQ ID NO: 12371) | |
| 84 | CTRTCAA + CA + T + AATTG (SEQ ID NO: 12372) | |
| 84 | CTRTCAA + CA + TAAT + TG (SEQ ID NO: 12373) | |
| 84 | CTRTCAA + CA + TAATTGG (SEQ ID NO: 12374) | |
| 84 | TCCAATTATGTTGAC (SEQ ID NO: 12375) | |
| 84 | CCTRTCAACATAATTGGRMG (SEQ ID NO: 12376) | |
| 84 | CCTRTCAACATAATTGGRM (SEQ ID NO: 12377) | |
| 84 | CTRTCAACATAATTGGR (SEQ ID NO: 12378) | |
| 84 | CTRTCAACATAATTG (SEQ ID NO: 12379) | |
| 88 | T + TGGRMGRAAYHTGTTGACY (SEQ ID NO: 12380) | |
| 88 | TTGG + RMGRAAYHTGTTGACY (SEQ ID NO: 12381) | |
| 88 | TTG + GRMGRAAYHTGTTGACY (SEQ ID NO: 12382) | |
| 88 | TT + GGRMGRAAYHTGTTGACY (SEQ ID NO: 12383) | |
| 88 | TTGGRMGRAAYHTGTTGA + CY (SEQ ID NO: 12384) | |
| 88 | TTGGRMGRAAYHTGTT + GACY (SEQ ID NO: 12385) | |
| 88 | TTGGRMGRAAYHTG + TTGACY (SEQ ID NO: 12386) | |
| 88 | TTGGRMGRAAYH + TGTTGACY (SEQ ID NO: 12387) | |
| 88 | TTGGRM + GR + AA + YHTGTTGACY (SEQ ID NO: 12388) | |
| 88 | TT + GGRMGR + AA + YHTGTTGACY (SEQ ID NO: 12389) | |
| 88 | TTGGRMG + R + AA + YHTGTTGACY (SEQ ID NO: 12390) | |
| 88 | TTGGR + MGR + AA + YHTGTTGACY (SEQ ID NO: 12391) | |
| 88 | TTGGRMGR + AA + YHTGTTGA + CY (SEQ ID NO: 12392) | |
| 88 | TTGGRMGR + AA + Y + HTGTTGACY (SEQ ID NO: 12393) | |
| 88 | TTGGRMGR + AA + YHTG + TTGACY (SEQ ID NO: 12394) | |
| 88 | TTGGRMGR + AA + YH + TGTTGACY (SEQ ID NO: 12395) | |
| 88 | T + TGGRMGRAAYHTGTTGAC (SEQ ID NO: 12396) | |

TABLE 10 -continued

| 88 | TTGG + RMGRAAYHTGTTGAC (SEQ ID NO: 12397) |
| 88 | TTG + GRMGRAAYHTGTTGAC (SEQ ID NO: 12398) |
| 88 | TT + GGRMGRAAYHTGTTGAC (SEQ ID NO: 12399) |
| 88 | TTGGRMGRAAYHTGTTGA + C (SEQ ID NO: 12400) |
| 88 | TTGGRMGRAAYHTGTT + GAC (SEQ ID NO: 12401) |
| 88 | TTGGRMGRAAYHTG + TTGAC (SEQ ID NO: 12402) |
| 88 | TTGGRMGRAAYH + TGTTGAC (SEQ ID NO: 12403) |
| 88 | TTGGRM + GR + AA + YHTGTTGAC (SEQ ID NO: 12404) |
| 88 | TT + GGRMGR + AA + YHTGTTGAC (SEQ ID NO: 12405) |
| 88 | TTGGRMG + R + AA + YHTGTTGAC (SEQ ID NO: 12406) |
| 88 | TTGGR + MGR + AA + YHTGTTGAC (SEQ ID NO: 12407) |
| 88 | TTGGRMGR + AA + YHTGTTGA + C (SEQ ID NO: 12408) |
| 88 | TTGGRMGR + AA + Y + HTGTTGAC (SEQ ID NO: 12409) |
| 88 | TTGGRMGR + AA + YHTG + TTGAC (SEQ ID NO: 12410) |
| 88 | TTGGRMGR + AA + YH + TGTTGAC (SEQ ID NO: 12411) |
| 88 | +TGGRMGRAAYHTGTTGA (SEQ ID NO: 12412) |
| 88 | TGG + RMGRAAYHTGTTGA (SEQ ID NO: 12413) |
| 88 | TG + GRMGRAAYHTGTTGA (SEQ ID NO: 12414) |
| 88 | T + GGRMGRAAYHTGTTGA (SEQ ID NO: 12415) |
| 88 | TGGRMGRAAYHTGTTGA (SEQ ID NO: 12416) |
| 88 | TGGRMGRAAYHTGTT + GA (SEQ ID NO: 12417) |
| 88 | TGGRMGRAAYHTG + TTGA (SEQ ID NO: 12418) |
| 88 | TGGRMGRAAYH + TGTTGA (SEQ ID NO: 12419) |
| 88 | TGGRM + GR + AA + YHTGTTGA (SEQ ID NO: 12420) |
| 88 | T + GGRMGR + AA + YHTGTTGA (SEQ ID NO: 12421) |
| 88 | TGGRMG + R + AA + YHTGTTGA (SEQ ID NO: 12422) |
| 88 | TGGR + MGR + AA + YHTGTTGA (SEQ ID NO: 12423) |
| 88 | TGGRMGR + AA + YHTGTTGA (SEQ ID NO: 12424) |
| 88 | TGGRMGR + AA + Y + HTGTTGA (SEQ ID NO: 12425) |
| 88 | TGGRMGR + AA + YHTG + TTGA (SEQ ID NO: 12426) |
| 88 | TGGRMGR + AA + YH + TGTTGA (SEQ ID NO: 12427) |
| 88 | +TGGRMGRAAYHTGTT (SEQ ID NO: 12428) |
| 88 | TGG + RMGRAAYHTGTT (SEQ ID NO: 12429) |
| 88 | TG + GRMGRAAYHTGTT (SEQ ID NO: 12430) |
| 88 | T + GGRMGRAAYHTGTT (SEQ ID NO: 12431) |
| 88 | TGGRMGRAAYHTGTTG (SEQ ID NO: 12432) |
| 88 | TGGRMGRAAYHTGTT (SEQ ID NO: 12433) |
| 88 | TGGRMGRAAYHTG + TT (SEQ ID NO: 12434) |
| 88 | TGGRMGRAAYH + TGTT (SEQ ID NO: 12435) |
| 88 | TGGRM + GR + AA + YHTGTT (SEQ ID NO: 12436) |

TABLE 10 -continued

| | | |
|---|---|---|
| 88 | T + GGRMGR + AA + YHTGTT | (SEQ ID NO: 12437) |
| 88 | TGGRMG + R + AA + YHTGTT | (SEQ ID NO: 12438) |
| 88 | TGGR + MGR + AA + YHTGTT | (SEQ ID NO: 12439) |
| 88 | TGGRMGR + AA + YHTGTTG | (SEQ ID NO: 12440) |
| 88 | TGGRMGR + AA + Y + HTGTT | (SEQ ID NO: 12441) |
| 88 | TGGRMGR + AA + YHTG + TT | (SEQ ID NO: 12442) |
| 88 | TGGRMGR + AA + YH + TGTT | (SEQ ID NO: 12443) |
| 88 | TGGAAGAAAYCTGTT | (SEQ ID NO: 12444) |
| 88 | TTGGRMGRAAYHTGTTGACY | (SEQ ID NO: 12445) |
| 88 | TTGGRMGRAAYHTGTTGAC | (SEQ ID NO: 12446) |
| 88 | TGGRMGRAAYHTGTTGA | (SEQ ID NO: 12447) |
| 88 | TGGRMGRAAYHTGTT | (SEQ ID NO: 12448) |
| 89 | G + GRMGRAAYYTGTTGACYCA | (SEQ ID NO: 12449) |
| 89 | GG + RMGRAAYYTGTTGACYCA | (SEQ ID NO: 12450) |
| 89 | GGRMGRAA + YYTGTTGACYCA | (SEQ ID NO: 12451) |
| 89 | GGR + MGRAAYYTGTTGACYCA | (SEQ ID NO: 12452) |
| 89 | GGRMGRAAYYTGTTGACY + CA | (SEQ ID NO: 12453) |
| 89 | GGRMGRAAYYTGTT + GACYCA | (SEQ ID NO: 12454) |
| 89 | GGRMGRAAYYTGT + TGACYCA | (SEQ ID NO: 12455) |
| 89 | GGRMGRAAYYTGTTG + ACYCA | (SEQ ID NO: 12456) |
| 89 | GG + RMGRAA + YY + TGTTGACYCA | (SEQ ID NO: 12457) |
| 89 | GGR + MGRAA + YY + TGTTGACYCA | (SEQ ID NO: 12458) |
| 89 | GGRMGRA + A + YY + TGTTGACYCA | (SEQ ID NO: 12459) |
| 89 | GGRMG + RAA + YY + TGTTGACYCA | (SEQ ID NO: 12460) |
| 89 | GGRMGRAA + YY + TGTTG + ACYCA | (SEQ ID NO: 12461) |
| 89 | GGRMGRAA + YY + T + GTTGACYCA | (SEQ ID NO: 12462) |
| 89 | GGRMGRAA + YY + TGTT + GACYCA | (SEQ ID NO: 12463) |
| 89 | GGRMGRAA + YY + TGTTGACY + CA | (SEQ ID NO: 12464) |
| 89 | G + GRMGRAAYYTGTTGACYC | (SEQ ID NO: 12465) |
| 89 | GG + RMGRAAYYTGTTGACYC | (SEQ ID NO: 12466) |
| 89 | GGRMGRAA + YYTGTTGACYC | (SEQ ID NO: 12467) |
| 89 | GGR + MGRAAYYTGTTGACYC | (SEQ ID NO: 12468) |
| 89 | GGRMGRAAYYTGTTGACY + C | (SEQ ID NO: 12469) |
| 89 | GGRMGRAAYYTGTT + GACYC | (SEQ ID NO: 12470) |
| 89 | GGRMGRAAYYTGT + TGACYC | (SEQ ID NO: 12471) |
| 89 | GGRMGRAAYYTGTTG + ACYC | (SEQ ID NO: 12472) |
| 89 | GG + RMGRAA + YY + TGTTGACYC | (SEQ ID NO: 12473) |
| 89 | GGR + MGRAA + YY + TGTTGACYC | (SEQ ID NO: 12474) |
| 89 | GGRMGRA + A + YY + TGTTGACYC | (SEQ ID NO: 12475) |
| 89 | GGRMG + RAA + YY + TGTTGACYC | (SEQ ID NO: 12476) |

TABLE 10 -continued

| 89 | GGRMGRAA + YY + TGTTG + ACYC (SEQ ID NO: 12477) |
| 89 | GGRMGRAA + YY + T + GTTGACYC (SEQ ID NO: 12478) |
| 89 | GGRMGRAA + YY + TGTT + GACYC (SEQ ID NO: 12479) |
| 89 | GGRMGRAA + YY + TGTTGACY + C (SEQ ID NO: 12480) |
| 89 | +GRMGRAAYYTGTTGACY (SEQ ID NO: 12481) |
| 89 | G + RMGRAAYYTGTTGACY (SEQ ID NO: 12482) |
| 89 | GRMGRAA + YYTGTTGACY (SEQ ID NO: 12483) |
| 89 | GR + MGRAAYYTGTTGACY (SEQ ID NO: 12484) |
| 89 | GRMGRAAYYTGTTGACY (SEQ ID NO: 12485) |
| 89 | GRMGRAAYYTGTT + GACY (SEQ ID NO: 12486) |
| 89 | GRMGRAAYYTGT + TGACY (SEQ ID NO: 12487) |
| 89 | GRMGRAAYYTGTTG + ACY (SEQ ID NO: 12488) |
| 89 | G + RMGRAA + YY + TGTTGACY (SEQ ID NO: 12489) |
| 89 | GR + MGRAA + YY + TGTTGACY (SEQ ID NO: 12490) |
| 89 | GRMGRA + A + YY + TGTTGACY (SEQ ID NO: 12491) |
| 89 | GRMG + RAA + YY + TGTTGACY (SEQ ID NO: 12492) |
| 89 | GRMGRAA + YY + TGTTG + ACY (SEQ ID NO: 12493) |
| 89 | GRMGRAA + YY + T + GTTGACY (SEQ ID NO: 12494) |
| 89 | GRMGRAA + YY + TGTT + GACY (SEQ ID NO: 12495) |
| 89 | GRMGRAA + YY + TGTTGACY (SEQ ID NO: 12496) |
| 89 | +GRMGRAAYYTGTTGA (SEQ ID NO: 12497) |
| 89 | G + RMGRAAYYTGTTGA (SEQ ID NO: 12498) |
| 89 | GRMGRAA + YYTGTTGA (SEQ ID NO: 12499) |
| 89 | GR + MGRAAYYTGTTGA (SEQ ID NO: 12500) |
| 89 | GRMGRAAYYTGTTGAC (SEQ ID NO: 12501) |
| 89 | GRMGRAAYYTGTT + GA (SEQ ID NO: 12502) |
| 89 | GRMGRAAYYTGT + TGA (SEQ ID NO: 12503) |
| 89 | GRMGRAAYYTGTTG + A (SEQ ID NO: 12504) |
| 89 | G + RMGRAA + YY + TGTTGA (SEQ ID NO: 12505) |
| 89 | GR + MGRAA + YY + TGTTGA (SEQ ID NO: 12506) |
| 89 | GRMGRA + A + YY + TGTTGA (SEQ ID NO: 12507) |
| 89 | GRMG + RAA + YY + TGTTGA (SEQ ID NO: 12508) |
| 89 | GRMGRAA + YY + TGTTG + A (SEQ ID NO: 12509) |
| 89 | GRMGRAA + YY + T + GTTGA (SEQ ID NO: 12510) |
| 89 | GRMGRAA + YY + TGTT + GA (SEQ ID NO: 12511) |
| 89 | GRMGRAA + YY + TGTTGAC (SEQ ID NO: 12512) |
| 89 | AAGAAATYTRTTGAC (SEQ ID NO: 12513) |
| 89 | GGRMGRAAYYTGTTGACYCA (SEQ ID NO: 12514) |
| 89 | GGRMGRAAYYTGTTGACYC (SEQ ID NO: 12515) |
| 89 | GRMGRAAYYTGTTGACY (SEQ ID NO: 12516) |

TABLE 10 -continued

| | |
|---|---|
| 89 | GRMGRAAYYTGTTGA (SEQ ID NO: 12517) |
| 90 | MGRAA + YHTGYTGACYCARMT (SEQ ID NO: 12518) |
| 90 | MGRAAYH + TGYTGACYCARMT (SEQ ID NO: 12519) |
| 90 | MGRA + AYHTGYTGACYCARMT (SEQ ID NO: 12520) |
| 90 | MGR + AAYHTGYTGACYCARMT (SEQ ID NO: 12521) |
| 90 | MGRAAYHTGYTGACYC + ARMT (SEQ ID NO: 12522) |
| 90 | MGRAAYHTGY + TGACYCARMT (SEQ ID NO: 12523) |
| 90 | MGRAAYHTGYTGACY + CARMT (SEQ ID NO: 12524) |
| 90 | MGRAAYHTGYTGAC + YCARMT (SEQ ID NO: 12525) |
| 90 | MGRA + AYHT + GY + TGACYCARMT (SEQ ID NO: 12526) |
| 90 | M + GRAAYHT + GY + TGACYCARMT (SEQ ID NO: 12527) |
| 90 | MG + RAAYHT + GY + TGACYCARMT (SEQ ID NO: 12528) |
| 90 | MGRAA + YHT + GY + TGACYCARMT (SEQ ID NO: 12529) |
| 90 | MGRAAYHT + GY + TGACYCA + RMT (SEQ ID NO: 12530) |
| 90 | MGRAAYHT + GY + T + GACYCARMT (SEQ ID NO: 12531) |
| 90 | MGRAAYHT + GY + TGAC + YCARMT (SEQ ID NO: 12532) |
| 90 | MGRAAYHT + GY + TGACYC + ARMT (SEQ ID NO: 12533) |
| 90 | MGRAA + YHTGYTGACYCARM (SEQ ID NO: 12534) |
| 90 | MGRAAYH + TGYTGACYCARM (SEQ ID NO: 12535) |
| 90 | MGRA + AYHTGYTGACYCARM (SEQ ID NO: 12536) |
| 90 | MGR + AAYHTGYTGACYCARM (SEQ ID NO: 12537) |
| 90 | MGRAAYHTGYTGACYC + ARM (SEQ ID NO: 12538) |
| 90 | MGRAAYHTGY + TGACYCARM (SEQ ID NO: 12539) |
| 90 | MGRAAYHTGYTGACY + CARM (SEQ ID NO: 12540) |
| 90 | MGRAAYHTGYTGAC + YCARM (SEQ ID NO: 12541) |
| 90 | MGRA + AYHT + GY + TGACYCARM (SEQ ID NO: 12542) |
| 90 | M + GRAAYHT + GY + TGACYCARM (SEQ ID NO: 12543) |
| 90 | MG + RAAYHT + GY + TGACYCARM (SEQ ID NO: 12544) |
| 90 | MGRAA + YHT + GY + TGACYCARM (SEQ ID NO: 12545) |
| 90 | MGRAAYHT + GY + TGACYCA + RM (SEQ ID NO: 12546) |
| 90 | MGRAAYHT + GY + T + GACYCARM (SEQ ID NO: 12547) |
| 90 | MGRAAYHT + GY + TGAC + YCARM (SEQ ID NO: 12548) |
| 90 | MGRAAYHT + GY + TGACYC + ARM (SEQ ID NO: 12549) |
| 90 | GRAA + YHTGYTGACYCAR (SEQ ID NO: 12550) |
| 90 | GRAAYH + TGYTGACYCAR (SEQ ID NO: 12551) |
| 90 | GRA + AYHTGYTGACYCAR (SEQ ID NO: 12552) |
| 90 | GR + AAYHTGYTGACYCAR (SEQ ID NO: 12553) |
| 90 | GRAAYHTGYTGACYC + AR (SEQ ID NO: 12554) |
| 90 | GRAAYHTGY + TGACYCAR (SEQ ID NO: 12555) |
| 90 | GRAAYHTGYTGACY + CAR (SEQ ID NO: 12556) |

TABLE 10 -continued

| | |
|---|---|
| 90 | GRAAYHTGYTGAC + YCAR (SEQ ID NO: 12557) |
| 90 | GRA + AYHT + GY + TGACYCAR (SEQ ID NO: 12558) |
| 90 | +GRAAYHT + GY + TGACYCAR (SEQ ID NO: 12559) |
| 90 | G + RAAYHT + GY + TGACYCAR (SEQ ID NO: 12560) |
| 90 | GRAA + YHT + GY + TGACYCAR (SEQ ID NO: 12561) |
| 90 | GRAAYHT + GY + TGACYCA + R (SEQ ID NO: 12562) |
| 90 | GRAAYHT + GY + T + GACYCAR (SEQ ID NO: 12563) |
| 90 | GRAAYHT + GY + TGAC + YCAR (SEQ ID NO: 12564) |
| 90 | GRAAYHT + GY + TGACYC + AR (SEQ ID NO: 12565) |
| 90 | GRAA + YHTGYTGACYC (SEQ ID NO: 12566) |
| 90 | GRAAYH + TGYTGACYC (SEQ ID NO: 12567) |
| 90 | GRA + AYHTGYTGACYC (SEQ ID NO: 12568) |
| 90 | GR + AAYHTGYTGACYC (SEQ ID NO: 12569) |
| 90 | GRAAYHTGYTGACYC (SEQ ID NO: 12570) |
| 90 | GRAAYHTGY + TGACYC (SEQ ID NO: 12571) |
| 90 | GRAAYHTGYTGACY + C (SEQ ID NO: 12572) |
| 90 | GRAAYHTGYTGAC + YC (SEQ ID NO: 12573) |
| 90 | GRA + AYHT + GY + TGACYC (SEQ ID NO: 12574) |
| 90 | +GRAAYHT + GY + TGACYC (SEQ ID NO: 12575) |
| 90 | G + RAAYHT + GY + TGACYC (SEQ ID NO: 12576) |
| 90 | GRAA + YHT + GY + TGACYC (SEQ ID NO: 12577) |
| 90 | GRAAYHT + GY + TGACYCA (SEQ ID NO: 12578) |
| 90 | GRAAYHT + GY + T + GACYC (SEQ ID NO: 12579) |
| 90 | GRAAYHT + GY + TGAC + YC (SEQ ID NO: 12580) |
| 90 | GRAAYHT + GY + TGACYC (SEQ ID NO: 12581) |
| 90 | AAATCTGYTRACTCA (SEQ ID NO: 12582) |
| 90 | MGRAAYHTGYTGACYCARMT (SEQ ID NO: 12583) |
| 90 | MGRAAYHTGYTGACYCARM (SEQ ID NO: 12584) |
| 90 | GRAAYHTGYTGACYCAR (SEQ ID NO: 12585) |
| 90 | GRAAYHTGYTGACYC (SEQ ID NO: 12586) |
| 90 | GRAAYHTGYTGACYCA (SEQ ID NO: 12587) |
| Codon | Mutant Probe (5' to 3') |
| 10 | CGACCCTTYGTCACA (SEQ ID NO: 12588) |
| 10 | CGACCCCGHGTCACA (SEQ ID NO: 12589) |
| 10 | CGACCCAGAGTCACA (SEQ ID NO: 12590) |
| 10 | CGACCCTAYGTCACA (SEQ ID NO: 12591) |
| 11 | CCCCTCATYACAATA (SEQ ID NO: 12592) |
| 11 | CCCCTCCTYACAATA (SEQ ID NO: 12593) |
| 20 | CAACTAACRGAAGCT (SEQ ID NO: 12594) |
| 20 | CAACTAGTRGAAGCT (SEQ ID NO: 12595) |

TABLE 10 -continued

| | |
|---|---|
| 23 | TATCTADATGAGCTT (SEQ ID NO: 12596) |
| 24 | TGTATCTATTAGAGC (SEQ ID NO: 12597) |
| 24 | TGTATCTAATAGAGC (SEQ ID NO: 12598) |
| 30 | TACTGTRTTATCTGC (SEQ ID NO: 12599) |
| 32 | TTCTAATATTGTATC (SEQ ID NO: 12600) |
| 33 | ACAGTATTYGAAGAA (SEQ ID NO: 12601) |
| 43 | AAATGGACRCCAAAA (SEQ ID NO: 12602) |
| 46 | CCAAAAATHATAGGG (SEQ ID NO: 12603) |
| 46 | CCAAAAYTGATAGGG (SEQ ID NO: 12604) |
| 46 | CCAAAAGTGATAGGG (SEQ ID NO: 12605) |
| 47 | CCAARAAT + G + TAGGRGGAAT (SEQ ID NO: 12606) |
| 47 | CCAA + RAATGTAGGRGGAAT (SEQ ID NO: 12607) |
| 47 | CCAARAAT + GTAGGRGGAAT (SEQ ID NO: 12608) |
| 47 | CC + AARAATGTAGGRGGAAT (SEQ ID NO: 12609) |
| 47 | CCAARAA + TGTAGGRGGAAT (SEQ ID NO: 12610) |
| 47 | CCAARAATGTAGG + RGGAAT (SEQ ID NO: 12611) |
| 47 | CCAARAATGTAGGR + GGAAT (SEQ ID NO: 12612) |
| 47 | CCAARAATGTAGGRG + GAAT (SEQ ID NO: 12613) |
| 47 | CCAARAATGTA + GGRGGAAT (SEQ ID NO: 12614) |
| 47 | CCA + ARAAT + G + TAGGRGGAAT (SEQ ID NO: 12615) |
| 47 | CC + AARAAT + G + TAGGRGGAAT (SEQ ID NO: 12616) |
| 47 | C + CAARAAT + G + TAGGRGGAAT (SEQ ID NO: 12617) |
| 47 | CCAARAA + T + G + TAGGRGGAAT (SEQ ID NO: 12618) |
| 47 | CCAARAAT + G + TA + GGRGGAAT (SEQ ID NO: 12619) |
| 47 | CCAARAAT + G + TAGGR + GGAAT (SEQ ID NO: 12620) |
| 47 | CCAARAAT + G + TAG + GRGGAAT (SEQ ID NO: 12621) |
| 47 | CCAARAAT + G + TAGGRGG + AAT (SEQ ID NO: 12622) |
| 47 | CCAARAAT + G + TAGGRGGAA (SEQ ID NO: 12623) |
| 47 | CCAA + RAATGTAGGRGGAA (SEQ ID NO: 12624) |
| 47 | CCAARAAT + GTAGGRGGAA (SEQ ID NO: 12625) |
| 47 | CC + AARAATGTAGGRGGAA (SEQ ID NO: 12626) |
| 47 | CCAARAA + TGTAGGRGGAA (SEQ ID NO: 12627) |
| 47 | CCAARAATGTAGG + RGGAA (SEQ ID NO: 12628) |
| 47 | CCAARAATGTAGGR + GGAA (SEQ ID NO: 12629) |
| 47 | CCAARAATGTAGGRG + GAA (SEQ ID NO: 12630) |
| 47 | CCAARAATGTA + GGRGGAA (SEQ ID NO: 12631) |
| 47 | CCA + ARAAT + G + TAGGRGGAA (SEQ ID NO: 12632) |
| 47 | CC + AARAAT + G + TAGGRGGAA (SEQ ID NO: 12633) |
| 47 | C + CAARAAT + G + TAGGRGGAA (SEQ ID NO: 12634) |
| 47 | CCAARAA + T + G + TAGGRGGAA (SEQ ID NO: 12635) |

TABLE 10 -continued

| | |
|---|---|
| 47 | CCAARAAT + G + TA + GGRGGAA (SEQ ID NO: 12636) |
| 47 | CCAARAAT + G + TAGGR + GGAA (SEQ ID NO: 12637) |
| 47 | CCAARAAT + G + TAG + GRGGAA (SEQ ID NO: 12638) |
| 47 | CCAARAAT + G + TAGGRGG + AA (SEQ ID NO: 12639) |
| 47 | CAARAAT + G + TAGGRGGAA (SEQ ID NO: 12640) |
| 47 | CAA + RAATGTAGGRGGAA (SEQ ID NO: 12641) |
| 47 | CAARAAT + GTAGGRGGAA (SEQ ID NO: 12642) |
| 47 | C + AARAATGTAGGRGGAA (SEQ ID NO: 12643) |
| 47 | CAARAA + TGTAGGRGGAA (SEQ ID NO: 12644) |
| 47 | CAARAATGTAGG + RGGAA (SEQ ID NO: 12645) |
| 47 | CAARAATGTAGGR + GGAA (SEQ ID NO: 12646) |
| 47 | CAARAATGTAGGRG + GAA (SEQ ID NO: 12647) |
| 47 | CAARAATGTA + GGRGGAA (SEQ ID NO: 12648) |
| 47 | CA + ARAAT + G + TAGGRGGAA (SEQ ID NO: 12649) |
| 47 | C + AARAAT + G + TAGGRGGAA (SEQ ID NO: 12650) |
| 47 | +CAARAAT + G + TAGGRGGAA (SEQ ID NO: 12651) |
| 47 | CAARAA + T + G + TAGGRGGAA (SEQ ID NO: 12652) |
| 47 | CAARAAT + G + TA + GGRGGAA (SEQ ID NO: 12653) |
| 47 | CAARAAT + G + TAGGR + GGAA (SEQ ID NO: 12654) |
| 47 | CAARAAT + G + TAG + GRGGAA (SEQ ID NO: 12655) |
| 47 | CAARAAT + G + TAGGRGG + AA (SEQ ID NO: 12656) |
| 47 | CAARAAT + G + TAGGRGG (SEQ ID NO: 12657) |
| 47 | CAA + RAATGTAGGRGG (SEQ ID NO: 12658) |
| 47 | CAARAAT + GTAGGRGG (SEQ ID NO: 12659) |
| 47 | C + AARAATGTAGGRGG (SEQ ID NO: 12660) |
| 47 | CAARAA + TGTAGGRGG (SEQ ID NO: 12661) |
| 47 | CAARAATGTAGG + RGG (SEQ ID NO: 12662) |
| 47 | CAARAATGTAGGR + GG (SEQ ID NO: 12663) |
| 47 | CAARAATGTAGGRG + G (SEQ ID NO: 12664) |
| 47 | CAARAATGTA + GGRGG (SEQ ID NO: 12665) |
| 47 | CA + ARAAT + G + TAGGRGG (SEQ ID NO: 12666) |
| 47 | C + AARAAT + G + TAGGRGG (SEQ ID NO: 12667) |
| 47 | +CAARAAT + G + TAGGRGG (SEQ ID NO: 12668) |
| 47 | CAARAA + T + G + TAGGRGG (SEQ ID NO: 12669) |
| 47 | CAARAAT + G + TA + GGRGG (SEQ ID NO: 12670) |
| 47 | CAARAAT + G + TAGGR + GG (SEQ ID NO: 12671) |
| 47 | CAARAAT + G + TAG + GRGG (SEQ ID NO: 12672) |
| 47 | CAARAAT + G + TAGGRGG (SEQ ID NO: 12673) |
| 47 | AAAATGGTAGGGGGA (SEQ ID NO: 12674) |
| 47 | AAAATGCTAGGGGGA (SEQ ID NO: 12675) |

TABLE 10 -continued

| | |
|---|---|
| 47 | CCAARAATGTAGGRGGAAT (SEQ ID NO: 12676) |
| 47 | CCAARAATGTAGGRGGAA (SEQ ID NO: 12677) |
| 47 | CAARAATGTAGGRGGAA (SEQ ID NO: 12678) |
| 47 | CAARAATGTAGGRGG (SEQ ID NO: 12679) |
| 48 | ATGATAGTRGGAATT (SEQ ID NO: 12680) |
| 48 | ATGATAATGGGAATT (SEQ ID NO: 12681) |
| 48 | ATGATAGCRGGAATT (SEQ ID NO: 12682) |
| 48 | ATGATAAGYGGAATT (SEQ ID NO: 12683) |
| 48 | ATGATAACRGGAATT (SEQ ID NO: 12684) |
| 48 | ATGATAYTRGGAATT (SEQ ID NO: 12685) |
| 48 | ATGATACARGGAATT (SEQ ID NO: 12686) |
| 50 | ATAGGRGG + A + TTGGAGGYTT (SEQ ID NO: 12687) |
| 50 | ATAGGR + GGATTGGAGGYTT (SEQ ID NO: 12688) |
| 50 | ATAG + GRGGATTGGAGGYTT (SEQ ID NO: 12689) |
| 50 | ATAGGRG + GATTGGAGGYTT (SEQ ID NO: 12690) |
| 50 | AT + AGGRGGATTGGAGGYTT (SEQ ID NO: 12691) |
| 50 | ATAGGRGGATT + GGAGGYTT (SEQ ID NO: 12692) |
| 50 | ATAGGRGGATTGGAG + GYTT (SEQ ID NO: 12693) |
| 50 | ATAGGRGGA + TTGGAGGYTT (SEQ ID NO: 12694) |
| 50 | ATAGGRGGATTGG + AGGYTT (SEQ ID NO: 12695) |
| 50 | ATAGGR + GG + A + TTGGAGGYTT (SEQ ID NO: 12696) |
| 50 | ATAGG + RGG + A + TTGGAGGYTT (SEQ ID NO: 12697) |
| 50 | A + TAGGRGG + A + TTGGAGGYTT (SEQ ID NO: 12698) |
| 50 | AT + AGGRGG + A + TTGGAGGYTT (SEQ ID NO: 12699) |
| 50 | ATAGGRGG + A + TTGGAGG + YTT (SEQ ID NO: 12700) |
| 50 | ATAGGRGG + A + TTGGAG + GYTT (SEQ ID NO: 12701) |
| 50 | ATAGGRGG + A + TTG + GAGGYTT (SEQ ID NO: 12702) |
| 50 | ATAGGRGG + A + TTGGA + GGYTT (SEQ ID NO: 12703) |
| 50 | ATAGGRGG + A + TTGGAGGYT (SEQ ID NO: 12704) |
| 50 | ATAGGR + GGATTGGAGGYT (SEQ ID NO: 12705) |
| 50 | ATAG + GRGGATTGGAGGYT (SEQ ID NO: 12706) |
| 50 | ATAGGRG + GATTGGAGGYT (SEQ ID NO: 12707) |
| 50 | AT + AGGRGGATTGGAGGYT (SEQ ID NO: 12708) |
| 50 | ATAGGRGGATT + GGAGGYT (SEQ ID NO: 12709) |
| 50 | ATAGGRGGATTGGAG + GYT (SEQ ID NO: 12710) |
| 50 | ATAGGRGGA + TTGGAGGYT (SEQ ID NO: 12711) |
| 50 | ATAGGRGGATTGG + AGGYT (SEQ ID NO: 12712) |
| 50 | ATAGGR + GG + A + TTGGAGGYT (SEQ ID NO: 12713) |
| 50 | ATAGG + RGG + A + TTGGAGGYT (SEQ ID NO: 12714) |
| 50 | A + TAGGRGG + A + TTGGAGGYT (SEQ ID NO: 12715) |

TABLE 10 -continued

| | |
|---|---|
| 50 | AT + AGGRGG + A + TTGGAGGYT (SEQ ID NO: 12716) |
| 50 | ATAGGRGG + A + TTGGAGG + YT (SEQ ID NO: 12717) |
| 50 | ATAGGRGG + A + TTGGAG + GYT (SEQ ID NO: 12718) |
| 50 | ATAGGRGG + A + TTG + GAGGYT (SEQ ID NO: 12719) |
| 50 | ATAGGRGG + A + TTGGA + GGYT (SEQ ID NO: 12720) |
| 50 | TAGGRGG + A + TTGGAGGYT (SEQ ID NO: 12721) |
| 50 | TAGGR + GGATTGGAGGYT (SEQ ID NO: 12722) |
| 50 | TAG + GRGGATTGGAGGYT (SEQ ID NO: 12723) |
| 50 | TAGGRG + GATTGGAGGYT (SEQ ID NO: 12724) |
| 50 | T + AGGRGGATTGGAGGYT (SEQ ID NO: 12725) |
| 50 | TAGGRGGATT + GGAGGYT (SEQ ID NO: 12726) |
| 50 | TAGGRGGATTGGAG + GYT (SEQ ID NO: 12727) |
| 50 | TAGGRGGA + TTGGAGGYT (SEQ ID NO: 12728) |
| 50 | TAGGRGGATTGG + AGGYT (SEQ ID NO: 12729) |
| 50 | TAGGR + GG + A + TTGGAGGYT (SEQ ID NO: 12730) |
| 50 | TAGG + RGG + A + TTGGAGGYT (SEQ ID NO: 12731) |
| 50 | (SEQ ID NO: 12732) |
| 50 | T + AGGRGG + A + TTGGAGGYT (SEQ ID NO: 12733) |
| 50 | TAGGRGG + A + TTGGAGG + YT (SEQ ID NO: 12734) |
| 50 | TAGGRGG + A + TTGGAG + GYT (SEQ ID NO: 12735) |
| 50 | TAGGRGG + A + TTG + GAGGYT (SEQ ID NO: 12736) |
| 50 | TAGGRGG + A + TTGGA + GGYT (SEQ ID NO: 12737) |
| 50 | TAGGRGG + A + TTGGAGG (SEQ ID NO: 12738) |
| 50 | TAGGR + GGATTGGAGG (SEQ ID NO: 12739) |
| 50 | TAG + GRGGATTGGAGG (SEQ ID NO: 12740) |
| 50 | TAGGRG + GATTGGAGG (SEQ ID NO: 12741) |
| 50 | T + AGGRGGATTGGAGG (SEQ ID NO: 12742) |
| 50 | TAGGRGGATT + GGAGG (SEQ ID NO: 12743) |
| 50 | TAGGRGGATTGGAG + G (SEQ ID NO: 12744) |
| 50 | TAGGRGGA + TTGGAGG (SEQ ID NO: 12745) |
| 50 | TAGGRGGATTGG + AGG (SEQ ID NO: 12746) |
| 50 | TAGGR + GG + A + TTGGAGG (SEQ ID NO: 12747) |
| 50 | TAGG + RGG + A + TTGGAGG (SEQ ID NO: 12748) |
| 50 | (SEQ ID NO: 12749) |
| 50 | T + AGGRGG + A + TTGGAGG (SEQ ID NO: 12750) |
| 50 | TAGGRGG + A + TTGGAGG (SEQ ID NO: 12751) |
| 50 | TAGGRGG + A + TTGGAG + G (SEQ ID NO: 12752) |
| 50 | TAGGRGG + A + TTG + GAGG (SEQ ID NO: 12753) |
| 50 | TAGGRGG + A + TTGGA + GG (SEQ ID NO: 12754) |
| 50 | ACCTCCAACTCCCCC (SEQ ID NO: 12755) |

TABLE 10 -continued

| | |
|---|---|
| 50 | ACCTCCAAGTCCCCC (SEQ ID NO: 12756) |
| 50 | ATAGGRGGATTGGAGGYTT (SEQ ID NO: 12757) |
| 50 | ATAGGRGGATTGGAGGYT (SEQ ID NO: 12758) |
| 50 | TAGGRGGATTGGAGGYT (SEQ ID NO: 12759) |
| 50 | TAGGRGGATTGGAGG (SEQ ID NO: 12760) |
| 53 | TGGAGGYT + T + ATYAARGTAA (SEQ ID NO: 12761) |
| 53 | TGGAGGY + TTATYAARGTAA (SEQ ID NO: 12762) |
| 53 | T + GGAGGYTTATYAARGTAA (SEQ ID NO: 12763) |
| 53 | TGGAGG + YTTATYAARGTAA (SEQ ID NO: 12764) |
| 53 | TG + GAGGYTTATYAARGTAA (SEQ ID NO: 12765) |
| 53 | TGGAGGYTTATYA + ARGTAA (SEQ ID NO: 12766) |
| 53 | TGGAGGYTTATYAAR + GTAA (SEQ ID NO: 12767) |
| 53 | TGGAGGYTT + ATYAARGTAA (SEQ ID NO: 12768) |
| 53 | TGGAGGYTTATY + AARGTAA (SEQ ID NO: 12769) |
| 53 | TGGA + GGYT + T + ATYAARGTAA (SEQ ID NO: 12770) |
| 53 | TG + GAGGYT + T + ATYAARGTAA (SEQ ID NO: 12771) |
| 53 | TGGAGGY + T + T + ATYAARGTAA (SEQ ID NO: 12772) |
| 53 | TGG + AGGYT + T + ATYAARGTAA (SEQ ID NO: 12773) |
| 53 | TGGAGGYT + T + ATY + AARGTAA (SEQ ID NO: 12774) |
| 53 | TGGAGGYT + T + AT + YAARGTAA (SEQ ID NO: 12775) |
| 53 | TGGAGGYT + T + ATYAA + RGTAA (SEQ ID NO: 12776) |
| 53 | TGGAGGYT + T + ATYAAR + GTAA (SEQ ID NO: 12777) |
| 53 | TTGGAGGY + T + TATYAARGTA (SEQ ID NO: 12778) |
| 53 | TTGGA + GGYTTATYAARGTA (SEQ ID NO: 12779) |
| 53 | TTGGAGG + YTTATYAARGTA (SEQ ID NO: 12780) |
| 53 | TTGGAG + GYTTATYAARGTA (SEQ ID NO: 12781) |
| 53 | TT + GGAGGYTTATYAARGTA (SEQ ID NO: 12782) |
| 53 | TTGGAGGYTTATYAA + RGTA (SEQ ID NO: 12783) |
| 53 | TTGGAGGYTTATYAAR + GTA (SEQ ID NO: 12784) |
| 53 | TTGGAGGYTT + ATYAARGTA (SEQ ID NO: 12785) |
| 53 | TTGGAGGYTTAT + YAARGTA (SEQ ID NO: 12786) |
| 53 | T + TGGAGGY + T + TATYAARGTA (SEQ ID NO: 12787) |
| 53 | TTGGAG + GY + T + TATYAARGTA (SEQ ID NO: 12788) |
| 53 | TTGG + AGGY + T + TATYAARGTA (SEQ ID NO: 12789) |
| 53 | TTGGAGG + Y + T + TATYAARGTA (SEQ ID NO: 12790) |
| 53 | TTGGAGGY + T + TATYA + ARGTA (SEQ ID NO: 12791) |
| 53 | TTGGAGGY + T + T + ATYAARGTA (SEQ ID NO: 12792) |
| 53 | TTGGAGGY + T + TATYAAR + GTA (SEQ ID NO: 12793) |
| 53 | TTGGAGGY + T + TATY + AARGTA (SEQ ID NO: 12794) |
| 53 | TGGAGGYT + T + ATYAARGTA (SEQ ID NO: 12795) |

TABLE 10 -continued

| | |
|---|---|
| 53 | TGGAGGY + TTATYAARGTA (SEQ ID NO: 12796) |
| 53 | T + GGAGGYTTATYAARGTA (SEQ ID NO: 12797) |
| 53 | TGGAGG + YTTATYAARGTA (SEQ ID NO: 12798) |
| 53 | TG + GAGGYTTATYAARGTA (SEQ ID NO: 12799) |
| 53 | TGGAGGYTTATYA + ARGTA (SEQ ID NO: 12800) |
| 53 | TGGAGGYTTATYAAR + GTA (SEQ ID NO: 12801) |
| 53 | TGGAGGYTT + ATYAARGTA (SEQ ID NO: 12802) |
| 53 | TGGAGGYTTATY + AARGTA (SEQ ID NO: 12803) |
| 53 | TGGA + GGYT + T + ATYAARGTA (SEQ ID NO: 12804) |
| 53 | TG + GAGGYT + T + ATYAARGTA (SEQ ID NO: 12805) |
| 53 | TGGAGGY + T + T + ATYAARGTA (SEQ ID NO: 12806) |
| 53 | TGG + AGGYT + T + ATYAARGTA (SEQ ID NO: 12807) |
| 53 | TGGAGGYT + T + ATY + AARGTA (SEQ ID NO: 12808) |
| 53 | TGGAGGYT + T + AT + YAARGTA (SEQ ID NO: 12809) |
| 53 | TGGAGGYT + T + ATYAA + RGTA (SEQ ID NO: 12810) |
| 53 | TGGAGGYT + T + ATYAAR + GTA (SEQ ID NO: 12811) |
| 53 | TTGGAGGY + T + TATYAARGT (SEQ ID NO: 12812) |
| 53 | TTGGA + GGYTTATYAARGT (SEQ ID NO: 12813) |
| 53 | TTGGAGG + YTTATYAARGT (SEQ ID NO: 12814) |
| 53 | TTGGAG + GYTTATYAARGT (SEQ ID NO: 12815) |
| 53 | TT + GGAGGYTTATYAARGT (SEQ ID NO: 12816) |
| 53 | TTGGAGGYTTATYAA + RGT (SEQ ID NO: 12817) |
| 53 | TTGGAGGYTTATYAAR + GT (SEQ ID NO: 12818) |
| 53 | TTGGAGGYTT + ATYAARGT (SEQ ID NO: 12819) |
| 53 | TTGGAGGYTTAT + YAARGT (SEQ ID NO: 12820) |
| 53 | T + TGGAGGY + T + TATYAARGT (SEQ ID NO: 12821) |
| 53 | TTGGAG + GY + T + TATYAARGT (SEQ ID NO: 12822) |
| 53 | TTGG + AGGY + T + TATYAARGT (SEQ ID NO: 12823) |
| 53 | TTGGAGG + Y + T + TATYAARGT (SEQ ID NO: 12824) |
| 53 | TTGGAGGY + T + TATYA + ARGT (SEQ ID NO: 12825) |
| 53 | TTGGAGGY + T + T + ATYAARGT (SEQ ID NO: 12826) |
| 53 | TTGGAGGY + T + TATYAAR + GT (SEQ ID NO: 12827) |
| 53 | TTGGAGGY + T + TATY + AARGT (SEQ ID NO: 12828) |
| 53 | GGAGGYT + T + ATYAARGTA (SEQ ID NO: 12829) |
| 53 | GGAGGY + TTATYAARGTA (SEQ ID NO: 12830) |
| 53 | +GGAGGYTTATYAARGTA (SEQ ID NO: 12831) |
| 53 | GGAGG + YTTATYAARGTA (SEQ ID NO: 12832) |
| 53 | G + GAGGYTTATYAARGTA (SEQ ID NO: 12833) |
| 53 | GGAGGYTTATYA + ARGTA (SEQ ID NO: 12834) |
| 53 | GGAGGYTTATYAAR + GTA (SEQ ID NO: 12835) |

TABLE 10 -continued

| | |
|---|---|
| 53 | GGAGGYTT + ATYAARGTA (SEQ ID NO: 12836) |
| 53 | GGAGGYTTATY + AARGTA (SEQ ID NO: 12837) |
| 53 | GGA + GGYT + T + ATYAARGTA (SEQ ID NO: 12838) |
| 53 | G + GAGGYT + T + ATYAARGTA (SEQ ID NO: 12839) |
| 53 | GGAGGY + T + T + ATYAARGTA (SEQ ID NO: 12840) |
| 53 | GG + AGGYT + T + ATYAARGTA (SEQ ID NO: 12841) |
| 53 | GGAGGYT + T + ATY + AARGTA (SEQ ID NO: 12842) |
| 53 | GGAGGYT + T + AT + YAARGTA (SEQ ID NO: 12843) |
| 53 | GGAGGYT + T + ATYAA + RGTA (SEQ ID NO: 12844) |
| 53 | GGAGGYT + T + ATYAAR + GTA (SEQ ID NO: 12845) |
| 53 | TGGAGGY + T + TATYAARGT (SEQ ID NO: 12846) |
| 53 | TGGA + GGYTTATYAARGT (SEQ ID NO: 12847) |
| 53 | TGGAGG + YTTATYAARGT (SEQ ID NO: 12848) |
| 53 | TGGAG + GYTTATYAARGT (SEQ ID NO: 12849) |
| 53 | T + GGAGGYTTATYAARGT (SEQ ID NO: 12850) |
| 53 | TGGAGGYTTATYAA + RGT (SEQ ID NO: 12851) |
| 53 | TGGAGGYTTATYAAR + GT (SEQ ID NO: 12852) |
| 53 | TGGAGGYTT + ATYAARGT (SEQ ID NO: 12853) |
| 53 | TGGAGGYTTAT + YAARGT (SEQ ID NO: 12854) |
| 53 | +TGGAGGY + T + TATYAARGT (SEQ ID NO: 12855) |
| 53 | TGGAG + GY + T + TATYAARGT (SEQ ID NO: 12856) |
| 53 | TGG + AGGY + T + TATYAARGT (SEQ ID NO: 12857) |
| 53 | TGGAGG + Y + T + TATYAARGT (SEQ ID NO: 12858) |
| 53 | TGGAGGY + T + TATYA + ARGT (SEQ ID NO: 12859) |
| 53 | TGGAGGY + T + T + ATYAARGT (SEQ ID NO: 12860) |
| 53 | TGGAGGY + T + TATYAAR + GT (SEQ ID NO: 12861) |
| 53 | TGGAGGY + T + TATY + AARGT (SEQ ID NO: 12862) |
| 53 | GGAGGYT + T + ATYAARG (SEQ ID NO: 12863) |
| 53 | GGAGGY + TTATYAARG (SEQ ID NO: 12864) |
| 53 | +GGAGGYTTATYAARG (SEQ ID NO: 12865) |
| 53 | GGAGG + YTTATYAARG (SEQ ID NO: 12866) |
| 53 | G + GAGGYTTATYAARG (SEQ ID NO: 12867) |
| 53 | GGAGGYTTATYA + ARG (SEQ ID NO: 12868) |
| 53 | GGAGGYTTATYAAR + G (SEQ ID NO: 12869) |
| 53 | GGAGGYTT + ATYAARG (SEQ ID NO: 12870) |
| 53 | GGAGGYTTATY + AARG (SEQ ID NO: 12871) |
| 53 | GGA + GGYT + T + ATYAARG (SEQ ID NO: 12872) |
| 53 | G + GAGGYT + T + ATYAARG (SEQ ID NO: 12873) |
| 53 | GGAGGY + T + T + ATYAARG (SEQ ID NO: 12874) |
| 53 | GG + AGGYT + T + ATYAARG (SEQ ID NO: 12875) |

TABLE 10 -continued

| | |
|---|---|
| 53 | GGAGGYT + T + ATY + AARG (SEQ ID NO: 12876) |
| 53 | GGAGGYT + T + AT + YAARG (SEQ ID NO: 12877) |
| 53 | GGAGGYT + T + ATYAA + RG (SEQ ID NO: 12878) |
| 53 | GGAGGYT + T + ATYAAR + G (SEQ ID NO: 12879) |
| 53 | TGGAGGY + T + TATYAAR (SEQ ID NO: 12880) |
| 53 | TGGA + GGYTTATYAAR (SEQ ID NO: 12881) |
| 53 | TGGAGG + YTTATYAAR (SEQ ID NO: 12882) |
| 53 | TGGAG + GYTTATYAAR (SEQ ID NO: 12883) |
| 53 | T + GGAGGYTTATYAAR (SEQ ID NO: 12884) |
| 53 | TGGAGGYTTATYAA + R (SEQ ID NO: 12885) |
| 53 | TGGAGGYTTATYAAR (SEQ ID NO: 12886) |
| 53 | TGGAGGYTT + ATYAAR (SEQ ID NO: 12887) |
| 53 | TGGAGGYTTAT + YAAR (SEQ ID NO: 12888) |
| 53 | +TGGAGGY + T + TATYAAR (SEQ ID NO: 12889) |
| 53 | TGGAG + GY + T + TATYAAR (SEQ ID NO: 12890) |
| 53 | TGG + AGGY + T + TATYAAR (SEQ ID NO: 12891) |
| 53 | TGGAGG + Y + T + TATYAAR (SEQ ID NO: 12892) |
| 53 | TGGAGGY + T + TATYA + AR (SEQ ID NO: 12893) |
| 53 | TGGAGGY + T + T + ATYAAR (SEQ ID NO: 12894) |
| 53 | TGGAGGY + T + TATYAAR (SEQ ID NO: 12895) |
| 53 | TGGAGGY + T + TATY + AAR (SEQ ID NO: 12896) |
| 53 | TTTGATRAGACCTCC (SEQ ID NO: 12897) |
| 53 | TTTGATYAAACCTCC (SEQ ID NO: 12898) |
| 53 | TTTGATRTAACCTCC (SEQ ID NO: 12899) |
| 53 | TGGAGGYTTATYAARGTAA (SEQ ID NO: 12900) |
| 53 | TTGGAGGYTTATYAARGTA (SEQ ID NO: 12901) |
| 53 | TGGAGGYTTATYAARGTA (SEQ ID NO: 12902) |
| 53 | TTGGAGGYTTATYAARGT (SEQ ID NO: 12903) |
| 53 | GGAGGYTTATYAARGTA (SEQ ID NO: 12904) |
| 53 | TGGAGGYTTATYAARGT (SEQ ID NO: 12905) |
| 53 | GGAGGYTTATYAARG (SEQ ID NO: 12906) |
| 53 | TGGAGGYTTATYAAR (SEQ ID NO: 12907) |
| 54 | AGGYTTTA + T + AARGTAARRC (SEQ ID NO: 12908) |
| 54 | AGGYT + TTATAARGTAARRC (SEQ ID NO: 12909) |
| 54 | AGGYTTTA + TAARGTAARRC (SEQ ID NO: 12910) |
| 54 | AGGYTT + TATAARGTAARRC (SEQ ID NO: 12911) |
| 54 | AGGYTTT + ATAARGTAARRC (SEQ ID NO: 12912) |
| 54 | AGGYTTTAT + AARGTAARRC (SEQ ID NO: 12913) |
| 54 | AGGYTTTATAARG + TAARRC (SEQ ID NO: 12914) |
| 54 | AGGYTTTATAARGTA + ARRC (SEQ ID NO: 12915) |

TABLE 10 -continued

| | | |
|---|---|---|
| 54 | AGGYTTTATAA + RGTAARRC | (SEQ ID NO: 12916) |
| 54 | AGGYT + TTA + T + AARGTAARRC | (SEQ ID NO: 12917) |
| 54 | AGGY + TTTA + T + AARGTAARRC | (SEQ ID NO: 12918) |
| 54 | AGG + YTTTA + T + AARGTAARRC | (SEQ ID NO: 12919) |
| 54 | AG + GYTTTA + T + AARGTAARRC | (SEQ ID NO: 12920) |
| 54 | AGGYTTTA + T + AAR + GTAARRC | (SEQ ID NO: 12921) |
| 54 | AGGYTTTA + T + AARGTAAR + RC | (SEQ ID NO: 12922) |
| 54 | AGGYTTTA + T + AA + RGTAARRC | (SEQ ID NO: 12923) |
| 54 | AGGYTTTA + T + A + ARGTAARRC | (SEQ ID NO: 12924) |
| 54 | GAGGYTTT + A + YAARGTAARR | (SEQ ID NO: 12925) |
| 54 | GAGGYT + TTAYAARGTAARR | (SEQ ID NO: 12926) |
| 54 | GA + GGYTTTAYAARGTAARR | (SEQ ID NO: 12927) |
| 54 | GAGGYTT + TAYAARGTAARR | (SEQ ID NO: 12928) |
| 54 | GAG + GYTTTAYAARGTAARR | (SEQ ID NO: 12929) |
| 54 | GAGGYTTTA + YAARGTAARR | (SEQ ID NO: 12930) |
| 54 | GAGGYTTTAYAA + RGTAARR | (SEQ ID NO: 12931) |
| 54 | GAGGYTTTAYAARGT + AARR | (SEQ ID NO: 12932) |
| 54 | GAGGYTTTAY + AARGTAARR | (SEQ ID NO: 12933) |
| 54 | GAGGYT + TT + A + YAARGTAARR | (SEQ ID NO: 12934) |
| 54 | GAG + GYTTT + A + YAARGTAARR | (SEQ ID NO: 12935) |
| 54 | GA + GGYTTT + A + YAARGTAARR | (SEQ ID NO: 12936) |
| 54 | GAGG + YTTT + A + YAARGTAARR | (SEQ ID NO: 12937) |
| 54 | GAGGYTTT + A + YAARGT + AARR | (SEQ ID NO: 12938) |
| 54 | GAGGYTTT + A + YAARG + TAARR | (SEQ ID NO: 12939) |
| 54 | GAGGYTTT + A + YAA + RGTAARR | (SEQ ID NO: 12940) |
| 54 | GAGGYTTT + A + Y + AARGTAARR | (SEQ ID NO: 12941) |
| 54 | GGAGGYTT + T + TYAARGTAAR | (SEQ ID NO: 12942) |
| 54 | GGA + GGYTTTTYAARGTAAR | (SEQ ID NO: 12943) |
| 54 | G + GAGGYTTTTYAARGTAAR | (SEQ ID NO: 12944) |
| 54 | GG + AGGYTTTTYAARGTAAR | (SEQ ID NO: 12945) |
| 54 | GGAGGY + TTTTYAARGTAAR | (SEQ ID NO: 12946) |
| 54 | GGAGGYTTTTY + AARGTAAR | (SEQ ID NO: 12947) |
| 54 | GGAGGYTTTTYAARGT + AAR | (SEQ ID NO: 12948) |
| 54 | GGAGGYTTTTYAARG + TAAR | (SEQ ID NO: 12949) |
| 54 | GGAGGYTTTTYAARGTA + AR | (SEQ ID NO: 12950) |
| 54 | GG + AGGYTT + T + TYAARGTAAR | (SEQ ID NO: 12951) |
| 54 | G + GAGGYTT + T + TYAARGTAAR | (SEQ ID NO: 12952) |
| 54 | GGAGGY + TT + T + TYAARGTAAR | (SEQ ID NO: 12953) |
| 54 | GGA + GGYTT + T + TYAARGTAAR | (SEQ ID NO: 12954) |
| 54 | GGAGGYTT + T + TYAA + RGTAAR | (SEQ ID NO: 12955) |

TABLE 10 -continued

| | |
|---|---|
| 54 | GGAGGYTT + T + TYA + ARGTAAR (SEQ ID NO: 12956) |
| 54 | GGAGGYTT + T + TYAAR + GTAAR (SEQ ID NO: 12957) |
| 54 | GGAGGYTT + T + TY + AARGTAAR (SEQ ID NO: 12958) |
| 54 | AGGYTTTA + T + AARGTAARR (SEQ ID NO: 12959) |
| 54 | AGGYT + TTATAARGTAARR (SEQ ID NO: 12960) |
| 54 | AGGYTTTA + TAARGTAARR (SEQ ID NO: 12961) |
| 54 | AGGYTT + TATAARGTAARR (SEQ ID NO: 12962) |
| 54 | AGGYTTT + ATAARGTAARR (SEQ ID NO: 12963) |
| 54 | AGGYTTTAT + AARGTAARR (SEQ ID NO: 12964) |
| 54 | AGGYTTTATAARG + TAARR (SEQ ID NO: 12965) |
| 54 | AGGYTTTATAARGTA + ARR (SEQ ID NO: 12966) |
| 54 | AGGYTTTATAA + RGTAARR (SEQ ID NO: 12967) |
| 54 | AGGYT + TTA + T + AARGTAARR (SEQ ID NO: 12968) |
| 54 | AGGY + TTTA + T + AARGTAARR (SEQ ID NO: 12969) |
| 54 | AGG + YTTTA + T + AARGTAARR (SEQ ID NO: 12970) |
| 54 | AG + GYTTTA + T + AARGTAARR (SEQ ID NO: 12971) |
| 54 | AGGYTTTA + T + AAR + GTAARR (SEQ ID NO: 12972) |
| 54 | AGGYTTTA + T + AARGTAAR + R (SEQ ID NO: 12973) |
| 54 | AGGYTTTA + T + AA + RGTAARR (SEQ ID NO: 12974) |
| 54 | AGGYTTTA + T + A + ARGTAARR (SEQ ID NO: 12975) |
| 54 | GAGGYTTT + A + YAARGTAAR (SEQ ID NO: 12976) |
| 54 | GAGGYT + TTAYAARGTAAR (SEQ ID NO: 12977) |
| 54 | GA + GGYTTTAYAARGTAAR (SEQ ID NO: 12978) |
| 54 | GAGGYTT + TAYAARGTAAR (SEQ ID NO: 12979) |
| 54 | GAG + GYTTTAYAARGTAAR (SEQ ID NO: 12980) |
| 54 | GAGGYTTTA + YAARGTAAR (SEQ ID NO: 12981) |
| 54 | GAGGYTTTAYAA + RGTAAR (SEQ ID NO: 12982) |
| 54 | GAGGYTTTAYAARGT + AAR (SEQ ID NO: 12983) |
| 54 | GAGGYTTTAY + AARGTAAR (SEQ ID NO: 12984) |
| 54 | GAGGYT + TT + A + YAARGTAAR (SEQ ID NO: 12985) |
| 54 | GAG + GYTTT + A + YAARGTAAR (SEQ ID NO: 12986) |
| 54 | GA + GGYTTT + A + YAARGTAAR (SEQ ID NO: 12987) |
| 54 | GAGG + YTTT + A + YAARGTAAR (SEQ ID NO: 12988) |
| 54 | GAGGYTTT + A + YAARGT + AAR (SEQ ID NO: 12989) |
| 54 | GAGGYTTT + A + YAARG + TAAR (SEQ ID NO: 12990) |
| 54 | GAGGYTTT + A + YAA + RGTAAR (SEQ ID NO: 12991) |
| 54 | GAGGYTTT + A + Y + AARGTAAR (SEQ ID NO: 12992) |
| 54 | GGAGGYTT + T + TYAARGTAA (SEQ ID NO: 12993) |
| 54 | GGA + GGYTTTTYAARGTAA (SEQ ID NO: 12994) |
| 54 | G + GAGGYTTTTYAARGTAA (SEQ ID NO: 12995) |

| | | |
|---|---|---|
| 54 | GG + AGGYTTTTYAARGTAA | (SEQ ID NO: 12996) |
| 54 | GGAGGY + TTTTYAARGTAA | (SEQ ID NO: 12997) |
| 54 | GGAGGYTTTTY + AARGTAA | (SEQ ID NO: 12998) |
| 54 | GGAGGYTTTTYAARGT + AA | (SEQ ID NO: 12999) |
| 54 | GGAGGYTTTTYAARG + TAA | (SEQ ID NO: 13000) |
| 54 | GGAGGYTTTTYAARGTA + A | (SEQ ID NO: 13001) |
| 54 | GG + AGGYTT + T + TYAARGTAA | (SEQ ID NO: 13002) |
| 54 | G + GAGGYTT + T + TYAARGTAA | (SEQ ID NO: 13003) |
| 54 | GGAGGY + TT + T + TYAARGTAA | (SEQ ID NO: 13004) |
| 54 | GGA + GGYTT + T + TYAARGTAA | (SEQ ID NO: 13005) |
| 54 | GGAGGYTT + T + TYAA + RGTAA | (SEQ ID NO: 13006) |
| 54 | GGAGGYTT + T + TYA + ARGTAA | (SEQ ID NO: 13007) |
| 54 | GGAGGYTT + T + TYAAR + GTAA | (SEQ ID NO: 13008) |
| 54 | GGAGGYTT + T + TY + AARGTAA | (SEQ ID NO: 13009) |
| 54 | GGYTTTA + T + AARGTAARR | (SEQ ID NO: 13010) |
| 54 | GGYT + TTATAARGTAARR | (SEQ ID NO: 13011) |
| 54 | GGYTTTA + TAARGTAARR | (SEQ ID NO: 13012) |
| 54 | GGYTT + TATAARGTAARR | (SEQ ID NO: 13013) |
| 54 | GGYTTT + ATAARGTAARR | (SEQ ID NO: 13014) |
| 54 | GGYTTTAT + AARGTAARR | (SEQ ID NO: 13015) |
| 54 | GGYTTTATAARG + TAARR | (SEQ ID NO: 13016) |
| 54 | GGYTTTATAARGTA + ARR | (SEQ ID NO: 13017) |
| 54 | GGYTTTATAA + RGTAARR | (SEQ ID NO: 13018) |
| 54 | GGYT + TTA + T + AARGTAARR | (SEQ ID NO: 13019) |
| 54 | GGY + TTTA + T + AARGTAARR | (SEQ ID NO: 13020) |
| 54 | GG + YTTTA + T + AARGTAARR | (SEQ ID NO: 13021) |
| 54 | G + GYTTTA + T + AARGTAARR | (SEQ ID NO: 13022) |
| 54 | GGYTTTA + T + AAR + GTAARR | (SEQ ID NO: 13023) |
| 54 | GGYTTTA + T + AARGTAAR + R | (SEQ ID NO: 13024) |
| 54 | GGYTTTA + T + AA + RGTAARR | (SEQ ID NO: 13025) |
| 54 | GGYTTTA + T + A + ARGTAARR | (SEQ ID NO: 13026) |
| 54 | AGGYTTT + A + YAARGTAAR | (SEQ ID NO: 13027) |
| 54 | AGGYT + TTAYAARGTAAR | (SEQ ID NO: 13028) |
| 54 | A + GGYTTTAYAARGTAAR | (SEQ ID NO: 13029) |
| 54 | AGGYTT + TAYAARGTAAR | (SEQ ID NO: 13030) |
| 54 | AG + GYTTTAYAARGTAAR | (SEQ ID NO: 13031) |
| 54 | AGGYTTTA + YAARGTAAR | (SEQ ID NO: 13032) |
| 54 | AGGYTTTAYAA + RGTAAR | (SEQ ID NO: 13033) |
| 54 | AGGYTTTAYAARGT + AAR | (SEQ ID NO: 13034) |
| 54 | AGGYTTTAY + AARGTAAR | (SEQ ID NO: 13035) |

TABLE 10 -continued

| | |
|---|---|
| 54 | AGGYT + TT + A + YAARGTAAR (SEQ ID NO: 13036) |
| 54 | AG + GYTTT + A + YAARGTAAR (SEQ ID NO: 13037) |
| 54 | A + GGYTTT + A + YAARGTAAR (SEQ ID NO: 13038) |
| 54 | AGG + YTTT + A + YAARGTAAR (SEQ ID NO: 13039) |
| 54 | AGGYTTT + A + YAARGT + AAR (SEQ ID NO: 13040) |
| 54 | AGGYTTT + A + YAARG + TAAR (SEQ ID NO: 13041) |
| 54 | AGGYTTT + A + YAA + RGTAAR (SEQ ID NO: 13042) |
| 54 | AGGYTTT + A + Y + AARGTAAR (SEQ ID NO: 13043) |
| 54 | GAGGYTT + T + TYAARGTAA (SEQ ID NO: 13044) |
| 54 | GA + GGYTTTTYAARGTAA (SEQ ID NO: 13045) |
| 54 | +GAGGYTTTTYAARGTAA (SEQ ID NO: 13046) |
| 54 | G + AGGYTTTTYAARGTAA (SEQ ID NO: 13047) |
| 54 | GAGGY + TTTTYAARGTAA (SEQ ID NO: 13048) |
| 54 | GAGGYTTTTY + AARGTAA (SEQ ID NO: 13049) |
| 54 | GAGGYTTTTYAARGT + AA (SEQ ID NO: 13050) |
| 54 | GAGGYTTTTYAARG + TAA (SEQ ID NO: 13051) |
| 54 | GAGGYTTTTYAARGTA + A (SEQ ID NO: 13052) |
| 54 | G + AGGYTT + T + TYAARGTAA (SEQ ID NO: 13053) |
| 54 | +GAGGYTT + T + TYAARGTAA (SEQ ID NO: 13054) |
| 54 | GAGGY + TT + T + TYAARGTAA (SEQ ID NO: 13055) |
| 54 | GA + GGYTT + T + TYAARGTAA (SEQ ID NO: 13056) |
| 54 | GAGGYTT + T + TYAA + RGTAA (SEQ ID NO: 13057) |
| 54 | GAGGYTT + T + TYA + ARGTAA (SEQ ID NO: 13058) |
| 54 | GAGGYTT + T + TYAAR + GTAA (SEQ ID NO: 13059) |
| 54 | GAGGYTT + T + TY + AARGTAA (SEQ ID NO: 13060) |
| 54 | GGYTTTA + T + AARGTAA (SEQ ID NO: 13061) |
| 54 | GGYT + TTATAARGTAA (SEQ ID NO: 13062) |
| 54 | GGYTTTA + TAARGTAA (SEQ ID NO: 13063) |
| 54 | GGYTT + TATAARGTAA (SEQ ID NO: 13064) |
| 54 | GGYTTT + ATAARGTAA (SEQ ID NO: 13065) |
| 54 | GGYTTTAT + AARGTAA (SEQ ID NO: 13066) |
| 54 | GGYTTTATAARG + TAA (SEQ ID NO: 13067) |
| 54 | GGYTTTATAARGTA + A (SEQ ID NO: 13068) |
| 54 | GGYTTTATAA + RGTAA (SEQ ID NO: 13069) |
| 54 | GGYT + TTA + T + AARGTAA (SEQ ID NO: 13070) |
| 54 | GGY + TTTA + T + AARGTAA (SEQ ID NO: 13071) |
| 54 | GG + YTTTA + T + AARGTAA (SEQ ID NO: 13072) |
| 54 | G + GYTTTA + T + AARGTAA (SEQ ID NO: 13073) |
| 54 | GGYTTTA + T + AAR + GTAA (SEQ ID NO: 13074) |
| 54 | GGYTTTA + T + AARGTAAR (SEQ ID NO: 13075) |

TABLE 10 -continued

| | |
|---|---|
| 54 | GGYTTTA + T + AA + RGTAA (SEQ ID NO: 13076) |
| 54 | GGYTTTA + T + A + ARGTAA (SEQ ID NO: 13077) |
| 54 | AGGYTTT + A + YAARGTA (SEQ ID NO:13078) |
| 54 | AGGYT + TTAYAARGTA (SEQ ID NO: 13079) |
| 54 | A + GGYTTTAYAARGTA (SEQ ID NO: 13080) |
| 54 | AGGYTT + TAYAARGTA (SEQ ID NO: 13081) |
| 54 | AG + GYTTTAYAARGTA (SEQ ID NO: 13082) |
| 54 | AGGYTTTA + YAARGTA (SEQ ID NO: 13083) |
| 54 | AGGYTTTAYAA + RGTA (SEQ ID NO: 13084) |
| 54 | AGGYTTTAYAARGT + A (SEQ ID NO: 13085) |
| 54 | AGGYTTTAY + AARGTA (SEQ ID NO: 13086) |
| 54 | AGGYT + TT + A + YAARGTA (SEQ ID NO: 13087) |
| 54 | AG + GYTTT + A + YAARGTA (SEQ ID NO: 13088) |
| 54 | A + GGYTTT + A + YAARGTA (SEQ ID NO: 13089) |
| 54 | AGG + YTTT + A + YAARGTA (SEQ ID NO: 13090) |
| 54 | AGGYTTT + A + YAARGT + A (SEQ ID NO: 13091) |
| 54 | AGGYTTT + A + YAARG + TA (SEQ ID NO: 13092) |
| 54 | AGGYTTT + A + YAA + RGTA (SEQ ID NO: 13093) |
| 54 | AGGYTTT + A + Y + AARGTA (SEQ ID NO: 13094) |
| 54 | GAGGYTT + T + TYAARGT (SEQ ID NO: 13095) |
| 54 | GA + GGYTTTTYAARGT (SEQ ID NO: 13096) |
| 54 | +GAGGYTTTTYAARGT (SEQ ID NO: 13097) |
| 54 | G + AGGYTTTTYAARGT (SEQ ID NO: 13098) |
| 54 | GAGGY + TTTTYAARGT (SEQ ID NO: 13099) |
| 54 | GAGGYTTTTY + AARGT (SEQ ID NO: 13100) |
| 54 | GAGGYTTTTYAARGT (SEQ ID NO: 13101) |
| 54 | GAGGYTTTTYAARG + T (SEQ ID NO: 13102) |
| 54 | GAGGYTTTTYAARGTA (SEQ ID NO: 13103) |
| 54 | G + AGGYTT + T + TYAARGT (SEQ ID NO: 13104) |
| 54 | +GAGGYTT + T + TYAARGT (SEQ ID NO: 13105) |
| 54 | GAGGY + TT + T + TYAARGT (SEQ ID NO: 13106) |
| 54 | GA + GGYTT + T + TYAARGT (SEQ ID NO: 13107) |
| 54 | GAGGYTT + T + TYAA + RGT (SEQ ID NO: 13108) |
| 54 | GAGGYTT + T + TYA + ARGT (SEQ ID NO: 13109) |
| 54 | GAGGYTT + T + TYAAR + GT (SEQ ID NO: 13110) |
| 54 | GAGGYTT + T + TY + AARGT (SEQ ID NO: 13111) |
| 54 | TACTTTRACAAAACC (SEQ ID NO: 13112) |
| 54 | TACTTTRGTAAAACC (SEQ ID NO: 13113) |
| 54 | TACTTTRGCAAAACC (SEQ ID NO: 13114) |
| 54 | TACTTTRAGAAAACC (SEQ ID NO: 13115) |

TABLE 10 -continued

| | |
|---|---|
| 54 | TACTTTRCTAAAACC (SEQ ID NO: 13116) |
| 54 | TACTTTCATAAAACC (SEQ ID NO: 13117) |
| 54 | AGGYTTTATAARGTAARRC (SEQ ID NO: 13118) |
| 54 | GAGGYTTTAYAARGTAARR (SEQ ID NO: 13119) |
| 54 | GGAGGYTTTTYAARGTAAR (SEQ ID NO: 13120) |
| 54 | AGGYTTTATAARGTAARR (SEQ ID NO: 13121) |
| 54 | GAGGYTTTAYAARGTAAR (SEQ ID NO: 13122) |
| 54 | GGAGGYTTTTYAARGTAA (SEQ ID NO: 13123) |
| 54 | GGYTTTATAARGTAARR (SEQ ID NO: 13124) |
| 54 | AGGYTTTAYAARGTAAR (SEQ ID NO: 13125) |
| 54 | GAGGYTTTTYAARGTAA (SEQ ID NO: 13126) |
| 54 | GGYTTTATAARGTAA (SEQ ID NO: 13127) |
| 54 | GGYTTTATAARGTAAR (SEQ ID NO: 13128) |
| 54 | AGGYTTTAYAARGTA (SEQ ID NO: 13129) |
| 54 | GAGGYTTTTYAARGT (SEQ ID NO: 13130) |
| 58 | AARGTAAR + R + ARTATGAKSA (SEQ ID NO: 13131) |
| 58 | AA + RGTAARRARTATGAKSA (SEQ ID NO: 13132) |
| 58 | AARGTAA + RRARTATGAKSA (SEQ ID NO: 13133) |
| 58 | A + ARGTAARRARTATGAKSA (SEQ ID NO: 13134) |
| 58 | AARGTAAR + RARTATGAKSA (SEQ ID NO: 13135) |
| 58 | AARGTAARRART + ATGAKSA (SEQ ID NO: 13136) |
| 58 | AARGTAARRARTATGAK + SA (SEQ ID NO: 13137) |
| 58 | AARGTAARRA + RTATGAKSA (SEQ ID NO: 13138) |
| 58 | AARGTAARRAR + TATGAKSA (SEQ ID NO: 13139) |
| 58 | AA + RGTAAR + R + ARTATGAKSA (SEQ ID NO: 13140) |
| 58 | AARG + TAAR + R + ARTATGAKSA (SEQ ID NO: 13141) |
| 58 | AAR + GTAAR + R + ARTATGAKSA (SEQ ID NO: 13142) |
| 58 | A + ARGTAAR + R + ARTATGAKSA (SEQ ID NO: 13143) |
| 58 | AARGTAAR + R + ARTATGAK + SA (SEQ ID NO: 13144) |
| 58 | AARGTAAR + R + ARTAT + GAKSA (SEQ ID NO: 13145) |
| 58 | AARGTAAR + R + ARTA + TGAKSA (SEQ ID NO: 13146) |
| 58 | AARGTAAR + R + AR + TATGAKSA (SEQ ID NO: 13147) |
| 58 | AARGTAAR + R + ARTATGAKS (SEQ ID NO: 13148) |
| 58 | AA + RGTAARRARTATGAKS (SEQ ID NO: 13149) |
| 58 | AARGTAA + RRARTATGAKS (SEQ ID NO: 13150) |
| 58 | A + ARGTAARRARTATGAKS (SEQ ID NO: 13151) |
| 58 | AARGTAAR + RARTATGAKS (SEQ ID NO: 13152) |
| 58 | AARGTAARRART + ATGAKS (SEQ ID NO: 13153) |
| 58 | AARGTAARRARTATGAK + S (SEQ ID NO: 13154) |
| 58 | AARGTAARRA + RTATGAKS (SEQ ID NO: 13155) |

TABLE 10 -continued

| 58 | AARGTAARRAR + TATGAKS (SEQ ID NO: 13156) |
| 58 | AA + RGTAAR + R + ARTATGAKS (SEQ ID NO: 13157) |
| 58 | AARG + TAAR + R + ARTATGAKS (SEQ ID NO: 13158) |
| 58 | AAR + GTAAR + R + ARTATGAKS (SEQ ID NO: 13159) |
| 58 | A + ARGTAAR + R + ARTATGAKS (SEQ ID NO: 13160) |
| 58 | AARGTAAR + R + ARTATGAK + S (SEQ ID NO: 13161) |
| 58 | AARGTAAR + R + ARTAT + GAKS (SEQ ID NO: 13162) |
| 58 | AARGTAAR + R + ARTA + TGAKS (SEQ ID NO: 13163) |
| 58 | AARGTAAR + R + AR + TATGAKS (SEQ ID NO: 13164) |
| 58 | ARGTAAR + R + ARTATGAKS (SEQ ID NO: 13165) |
| 58 | A + RGTAARRARTATGAKS (SEQ ID NO: 13166) |
| 58 | ARGTAA + RRARTATGAKS (SEQ ID NO: 13167) |
| 58 | +ARGTAARRARTATGAKS (SEQ ID NO: 13168) |
| 58 | ARGTAAR + RARTATGAKS (SEQ ID NO: 13169) |
| 58 | ARGTAARRART + ATGAKS (SEQ ID NO: 13170) |
| 58 | ARGTAARRARTATGAK + S (SEQ ID NO: 13171) |
| 58 | ARGTAARRA + RTATGAKS (SEQ ID NO: 13172) |
| 58 | ARGTAARRAR + TATGAKS (SEQ ID NO: 13173) |
| 58 | A + RGTAAR + R + ARTATGAKS (SEQ ID NO: 13174) |
| 58 | ARG + TAAR + R + ARTATGAKS (SEQ ID NO: 13175) |
| 58 | AR + GTAAR + R + ARTATGAKS (SEQ ID NO: 13176) |
| 58 | +ARGTAAR + R + ARTATGAKS (SEQ ID NO: 13177) |
| 58 | ARGTAAR + R + ARTATGAK + S (SEQ ID NO: 13178) |
| 58 | ARGTAAR + R + ARTAT + GAKS (SEQ ID NO: 13179) |
| 58 | ARGTAAR + R + ARTA + TGAKS (SEQ ID NO: 13180) |
| 58 | ARGTAAR + R + AR + TATGAKS (SEQ ID NO: 13181) |
| 58 | ARGTAAR + R + ARTATGA (SEQ ID NO: 13182) |
| 58 | A + RGTAARRARTATGA (SEQ ID NO: 13183) |
| 58 | ARGTAA + RRARTATGA (SEQ ID NO: 13184) |
| 58 | +ARGTAARRARTATGA (SEQ ID NO: 13185) |
| 58 | ARGTAAR + RARTATGA (SEQ ID NO: 13186) |
| 58 | ARGTAARRART + ATGA (SEQ ID NO: 13187) |
| 58 | ARGTAARRARTATGAK (SEQ ID NO: 13188) |
| 58 | ARGTAARRA + RTATGA (SEQ ID NO: 13189) |
| 58 | ARGTAARRAR + TATGA (SEQ ID NO: 13190) |
| 58 | A + RGTAAR + R + ARTATGA (SEQ ID NO: 13191) |
| 58 | ARG + TAAR + R + ARTATGA (SEQ ID NO: 13192) |
| 58 | AR + GTAAR + R + ARTATGA (SEQ ID NO: 13193) |
| 58 | +ARGTAAR + R + ARTATGA (SEQ ID NO: 13194) |
| 58 | ARGTAAR + R + ARTATGAK (SEQ ID NO: 13195) |

TABLE 10 -continued

| | |
|---|---|
| 58 | ARGTAAR + R + ARTAT + GA (SEQ ID NO: 13196) |
| 58 | ARGTAAR + R + ARTA + TGA (SEQ ID NO: 13197) |
| 58 | ARGTAAR + R + AR + TATGA (SEQ ID NO: 13198) |
| 58 | AGTAAGAGARTATGA (SEQ ID NO: 13199) |
| 58 | AARGTAARRARTATGAKSA (SEQ ID NO: 13200) |
| 58 | AARGTAARRARTATGAKS (SEQ ID NO: 13201) |
| 58 | ARGTAARRARTATGAKS (SEQ ID NO: 13202) |
| 58 | ARGTAARRARTATGA (SEQ ID NO: 13203) |
| 71 | GGRMAWAR + R + CYATAGGKWC (SEQ ID NO: 13204) |
| 71 | G + GRMAWARRCYATAGGKWC (SEQ ID NO: 13205) |
| 71 | GGRMAW + ARRCYATAGGKWC (SEQ ID NO: 13206) |
| 71 | GGR + MAWARRCYATAGGKWC (SEQ ID NO: 13207) |
| 71 | GGRM + AWARRCYATAGGKWC (SEQ ID NO: 13208) |
| 71 | GGRMAWARRCYATA + GGKWC (SEQ ID NO: 13209) |
| 71 | GGRMAWARRCYATAG + GKWC (SEQ ID NO: 13210) |
| 71 | GGRMAWARR + CYATAGGKWC (SEQ ID NO: 13211) |
| 71 | GGRMAWARRC + YATAGGKWC (SEQ ID NO: 13212) |
| 71 | G + GRMAWAR + R + CYATAGGKWC (SEQ ID NO: 13213) |
| 71 | GGRMAWA + R + R + CYATAGGKWC (SEQ ID NO: 13214) |
| 71 | GG + RMAWAR + R + CYATAGGKWC (SEQ ID NO: 13215) |
| 71 | GGRMAW + AR + R + CYATAGGKWC (SEQ ID NO: 13216) |
| 71 | GGRMAWAR + R + C + YATAGGKWC (SEQ ID NO: 13217) |
| 71 | GGRMAWAR + R + CYAT + AGGKWC (SEQ ID NO: 13218) |
| 71 | GGRMAWAR + R + CYATAGG + KWC (SEQ ID NO: 13219) |
| 71 | GGRMAWAR + R + CYA + TAGGKWC (SEQ ID NO: 13220) |
| 71 | GGRMAWAR + R + CYATAGGKW (SEQ ID NO: 13221) |
| 71 | G + GRMAWARRCYATAGGKW (SEQ ID NO: 13222) |
| 71 | GGRMAW + ARRCYATAGGKW (SEQ ID NO: 13223) |
| 71 | GGR + MAWARRCYATAGGKW (SEQ ID NO: 13224) |
| 71 | GGRM + AWARRCYATAGGKW (SEQ ID NO: 13225) |
| 71 | GGRMAWARRCYATA + GGKW (SEQ ID NO: 13226) |
| 71 | GGRMAWARRCYATAG + GKW (SEQ ID NO: 13227) |
| 71 | GGRMAWARR + CYATAGGKW (SEQ ID NO: 13228) |
| 71 | GGRMAWARRC + YATAGGKW (SEQ ID NO: 13229) |
| 71 | G + GRMAWAR + R + CYATAGGKW (SEQ ID NO: 13230) |
| 71 | GGRMAWA + R + R + CYATAGGKW (SEQ ID NO: 13231) |
| 71 | GG + RMAWAR + R + CYATAGGKW (SEQ ID NO: 13232) |
| 71 | GGRMAW + AR + R + CYATAGGKW (SEQ ID NO: 13233) |
| 71 | GGRMAWAR + R + C + YATAGGKW (SEQ ID NO: 13234) |
| 71 | GGRMAWAR + R + CYAT + AGGKW (SEQ ID NO: 13235) |

TABLE 10 -continued

| | |
|---|---|
| 71 | GGRMAWAR + R + CYATAGG + KW (SEQ ID NO: 13236) |
| 71 | GGRMAWAR + R + CYA + TAGGKW (SEQ ID NO: 13237) |
| 71 | GRMAWAR + R + CYATAGGKW (SEQ ID NO: 13238) |
| 71 | +GRMAWARRCYATAGGKW (SEQ ID NO: 13239) |
| 71 | GRMAW + ARRCYATAGGKW (SEQ ID NO: 13240) |
| 71 | GR + MAWARRCYATAGGKW (SEQ ID NO: 13241) |
| 71 | GRM + AWARRCYATAGGKW (SEQ ID NO: 13242) |
| 71 | GRMAWARRCYATA + GGKW (SEQ ID NO: 13243) |
| 71 | GRMAWARRCYATAG + GKW (SEQ ID NO: 13244) |
| 71 | GRMAWARR + CYATAGGKW (SEQ ID NO: 13245) |
| 71 | GRMAWARRC + YATAGGKW (SEQ ID NO: 13246) |
| 71 | +GRMAWAR + R + CYATAGGKW (SEQ ID NO: 13247) |
| 71 | GRMAWA + R + R + CYATAGGKW (SEQ ID NO: 13248) |
| 71 | G + RMAWAR + R + CYATAGGKW (SEQ ID NO: 13249) |
| 71 | GRMAW + AR + R + CYATAGGKW (SEQ ID NO: 13250) |
| 71 | GRMAWAR + R + C + YATAGGKW (SEQ ID NO: 13251) |
| 71 | GRMAWAR + R + CYAT + AGGKW (SEQ ID NO: 13252) |
| 71 | GRMAWAR + R + CYATAGG + KW (SEQ ID NO: 13253) |
| 71 | GRMAWAR + R + CYA + TAGGKW (SEQ ID NO: 13254) |
| 71 | GRMAWAR + R + CYATAGG (SEQ ID NO: 13255) |
| 71 | +GRMAWARRCYATAGG (SEQ ID NO: 13256) |
| 71 | GRMAW + ARRCYATAGG (SEQ ID NO: 13257) |
| 71 | GR + MAWARRCYATAGG (SEQ ID NO: 13258) |
| 71 | GRM + AWARRCYATAGG (SEQ ID NO: 13259) |
| 71 | GRMAWARRCYATA + GG (SEQ ID NO: 13260) |
| 71 | GRMAWARRCYATAG + G (SEQ ID NO: 13261) |
| 71 | GRMAWARR + CYATAGG (SEQ ID NO: 13262) |
| 71 | GRMAWARRC + YATAGG (SEQ ID NO: 13263) |
| 71 | +GRMAWAR + R + CYATAGG (SEQ ID NO: 13264) |
| 71 | GRMAWA + R + R + CYATAGG (SEQ ID NO: 13265) |
| 71 | G + RMAWAR + R + CYATAGG (SEQ ID NO: 13266) |
| 71 | GRMAW + AR + R + CYATAGG (SEQ ID NO: 13267) |
| 71 | GRMAWAR + R + C + YATAGG (SEQ ID NO: 13268) |
| 71 | GRMAWAR + R + CYAT + AGG (SEQ ID NO: 13269) |
| 71 | GRMAWAR + R + CYATAGG (SEQ ID NO: 13270) |
| 71 | GRMAWAR + R + CYA + TAGG (SEQ ID NO: 13271) |
| 71 | CATAAAATHATAGGT (SEQ ID NO: 13272) |
| 71 | CATAAACTHATAGGT (SEQ ID NO: 13273) |
| 71 | CATAAATTAATAGGT (SEQ ID NO: 13274) |
| 71 | GGRMAWARRCYATAGGKWC (SEQ ID NO: 13275) |

TABLE 10 -continued

| | |
|---|---|
| 71 | GGRMAWARRCYATAGGKW (SEQ ID NO: 13276) |
| 71 | GRMAWARRCYATAGGKW (SEQ ID NO: 13277) |
| 71 | GRMAWARRCYATAGG (SEQ ID NO: 13278) |
| 73 | RRGCYATA + G + KWCAGTRYTR (SEQ ID NO: 13279) |
| 73 | RRG + CYATAGKWCAGTRYTR (SEQ ID NO: 13280) |
| 73 | R + RGCYATAGKWCAGTRYTR (SEQ ID NO: 13281) |
| 73 | RRGC + YATAGKWCAGTRYTR (SEQ ID NO: 13282) |
| 73 | RRGCYAT + AGKWCAGTRYTR (SEQ ID NO: 13283) |
| 73 | RRGCYATAGKWCAGTRY + TR (SEQ ID NO: 13284) |
| 73 | RRGCYATAG + KWCAGTRYTR (SEQ ID NO: 13285) |
| 73 | RRGCYATAGKWC + AGTRYTR (SEQ ID NO: 13286) |
| 73 | RRGCYATAGK + WCAGTRYTR (SEQ ID NO: 13287) |
| 73 | RRGCYAT + A + G + KWCAGTRYTR (SEQ ID NO: 13288) |
| 73 | RRGCY + ATA + G + KWCAGTRYTR (SEQ ID NO: 13289) |
| 73 | RR + GCYATA + G + KWCAGTRYTR (SEQ ID NO: 13290) |
| 73 | RRG + CYATA + G + KWCAGTRYTR (SEQ ID NO: 13291) |
| 73 | RRGCYATA + G + KWC + AGTRYTR (SEQ ID NO: 13292) |
| 73 | RRGCYATA + G + K + WCAGTRYTR (SEQ ID NO: 13293) |
| 73 | RRGCYATA + G + KWCAGTR + YTR (SEQ ID NO: 13294) |
| 73 | RRGCYATA + G + KW + CAGTRYTR (SEQ ID NO: 13295) |
| 73 | ARRGCYAT + A + GKWCAGTRYT (SEQ ID NO: 13296) |
| 73 | ARRGCYA + TAGKWCAGTRYT (SEQ ID NO: 13297) |
| 73 | A + RRGCYATAGKWCAGTRYT (SEQ ID NO: 13298) |
| 73 | AR + RGCYATAGKWCAGTRYT (SEQ ID NO: 13299) |
| 73 | ARRG + CYATAGKWCAGTRYT (SEQ ID NO: 13300) |
| 73 | ARRGCYATAGKWC + AGTRYT (SEQ ID NO: 13301) |
| 73 | ARRGCYATAGK + WCAGTRYT (SEQ ID NO: 13302) |
| 73 | ARRGCYATAG + KWCAGTRYT (SEQ ID NO: 13303) |
| 73 | ARRGCYATAGKWCAGTR + YT (SEQ ID NO: 13304) |
| 73 | ARRGCYA + T + A + GKWCAGTRYT (SEQ ID NO: 13305) |
| 73 | ARRG + CYAT + A + GKWCAGTRYT (SEQ ID NO: 13306) |
| 73 | A + RRGCYAT + A + GKWCAGTRYT (SEQ ID NO: 13307) |
| 73 | ARRGCY + AT + A + GKWCAGTRYT (SEQ ID NO: 13308) |
| 73 | ARRGCYAT + A + GKWC + AGTRYT (SEQ ID NO: 13309) |
| 73 | ARRGCYAT + A + GKWCAGTR + YT (SEQ ID NO: 13310) |
| 73 | ARRGCYAT + A + GKW + CAGTRYT (SEQ ID NO: 13311) |
| 73 | ARRGCYAT + A + GK + WCAGTRYT (SEQ ID NO: 13312) |
| 73 | RRGCYATA + G + KWCAGTRYT (SEQ ID NO: 13313) |
| 73 | RRG + CYATAGKWCAGTRYT (SEQ ID NO: 13314) |
| 73 | R + RGCYATAGKWCAGTRYT (SEQ ID NO: 13315) |

TABLE 10 -continued

| 73 | RRGC + YATAGKWCAGTRYT (SEQ ID NO: 13316) |
| 73 | RRGCYAT + AGKWCAGTRYT (SEQ ID NO: 13317) |
| 73 | RRGCYATAGKWCAGTRY + T (SEQ ID NO: 13318) |
| 73 | RRGCYATAG + KWCAGTRYT (SEQ ID NO: 13319) |
| 73 | RRGCYATAGKWC + AGTRYT (SEQ ID NO: 13320) |
| 73 | RRGCYATAGK + WCAGTRYT (SEQ ID NO: 13321) |
| 73 | RRGCYAT + A + G + KWCAGTRYT (SEQ ID NO: 13322) |
| 73 | RRGCY + ATA + G + KWCAGTRYT (SEQ ID NO: 13323) |
| 73 | RR + GCYATA + G + KWCAGTRYT (SEQ ID NO: 13324) |
| 73 | RRG + CYATA + G + KWCAGTRYT (SEQ ID NO: 13325) |
| 73 | RRGCYATA + G + KWC + AGTRYT (SEQ ID NO: 13326) |
| 73 | RRGCYATA + G + K + WCAGTRYT (SEQ ID NO: 13327) |
| 73 | RRGCYATA + G + KWCAGTR + YT (SEQ ID NO: 13328) |
| 73 | RRGCYATA + G + KW + CAGTRYT (SEQ ID NO: 13329) |
| 73 | ARRGCYAT + A + GKWCAGTRY (SEQ ID NO: 13330) |
| 73 | ARRGCYA + TAGKWCAGTRY (SEQ ID NO: 13331) |
| 73 | A + RRGCYATAGKWCAGTRY (SEQ ID NO: 13332) |
| 73 | AR + RGCYATAGKWCAGTRY (SEQ ID NO: 13333) |
| 73 | ARRG + CYATAGKWCAGTRY (SEQ ID NO: 13334) |
| 73 | ARRGCYATAGKWC + AGTRY (SEQ ID NO: 13335) |
| 73 | ARRGCYATAGK + WCAGTRY (SEQ ID NO: 13336) |
| 73 | ARRGCYATAG + KWCAGTRY (SEQ ID NO: 13337) |
| 73 | ARRGCYATAGKWCAGTR + Y (SEQ ID NO: 13338) |
| 73 | ARRGCYA + T + A + GKWCAGTRY (SEQ ID NO: 13339) |
| 73 | ARRG + CYAT + A + GKWCAGTRY (SEQ ID NO: 13340) |
| 73 | A + RRGCYAT + A + GKWCAGTRY (SEQ ID NO: 13341) |
| 73 | ARRGCY + AT + A + GKWCAGTRY (SEQ ID NO: 13342) |
| 73 | ARRGCYAT + A + GKWC + AGTRY (SEQ ID NO: 13343) |
| 73 | ARRGCYAT + A + GKWCAGTR + Y (SEQ ID NO: 13344) |
| 73 | ARRGCYAT + A + GKW + CAGTRY (SEQ ID NO: 13345) |
| 73 | ARRGCYAT + A + GK + WCAGTRY (SEQ ID NO: 13346) |
| 73 | RGCYATA + G + KWCAGTRYT (SEQ ID NO: 13347) |
| 73 | RG + CYATAGKWCAGTRYT (SEQ ID NO: 13348) |
| 73 | +RGCYATAGKWCAGTRYT (SEQ ID NO: 13349) |
| 73 | RGC + YATAGKWCAGTRYT (SEQ ID NO: 13350) |
| 73 | RGCYAT + AGKWCAGTRYT (SEQ ID NO: 13351) |
| 73 | RGCYATAGKWCAGTRY + T (SEQ ID NO: 13352) |
| 73 | RGCYATAG + KWCAGTRYT (SEQ ID NO: 13353) |
| 73 | RGCYATAGKWC + AGTRYT (SEQ ID NO: 13354) |
| 73 | RGCYATAGK + WCAGTRYT (SEQ ID NO: 13355) |

TABLE 10 -continued

| 73 | RGCYAT + A + G + KWCAGTRYT (SEQ ID NO: 13356) |
| 73 | RGCY + ATA + G + KWCAGTRYT (SEQ ID NO: 13357) |
| 73 | R + GCYATA + G + KWCAGTRYT (SEQ ID NO: 13358) |
| 73 | RG + CYATA + G + KWCAGTRYT (SEQ ID NO: 13359) |
| 73 | RGCYATA + G + KWC + AGTRYT (SEQ ID NO: 13360) |
| 73 | RGCYATA + G + K + WCAGTRYT (SEQ ID NO: 13361) |
| 73 | RGCYATA + G + KWCAGTR + YT (SEQ ID NO: 13362) |
| 73 | RGCYATA + G + KW + CAGTRYT (SEQ ID NO: 13363) |
| 73 | RRGCYAT + A + GKWCAGTRY (SEQ ID NO: 13364) |
| 73 | RRGCYA + TAGKWCAGTRY (SEQ ID NO: 13365) |
| 73 | +RRGCYATAGKWCAGTRY (SEQ ID NO: 13366) |
| 73 | R + RGCYATAGKWCAGTRY (SEQ ID NO: 13367) |
| 73 | RRG + CYATAGKWCAGTRY (SEQ ID NO: 13368) |
| 73 | RRGCYATAGKWC + AGTRY (SEQ ID NO: 13369) |
| 73 | RRGCYATAGK + WCAGTRY (SEQ ID NO: 13370) |
| 73 | RRGCYATAG + KWCAGTRY (SEQ ID NO: 13371) |
| 73 | RRGCYATAGKWCAGTR + Y (SEQ ID NO: 13372) |
| 73 | RRGCYA + T + A + GKWCAGTRY (SEQ ID NO: 13373) |
| 73 | RRG + CYAT + A + GKWCAGTRY (SEQ ID NO: 13374) |
| 73 | +RRGCYAT + A + GKWCAGTRY (SEQ ID NO: 13375) |
| 73 | RRGCY + AT + A + GKWCAGTRY (SEQ ID NO: 13376) |
| 73 | RRGCYAT + A + GKWC + AGTRY (SEQ ID NO: 13377) |
| 73 | RRGCYAT + A + GKWCAGTR + Y (SEQ ID NO: 13378) |
| 73 | RRGCYAT + A + GKW + CAGTRY (SEQ ID NO: 13379) |
| 73 | RRGCYAT + A + GK + WCAGTRY (SEQ ID NO: 13380) |
| 73 | RGCYATA + G + KWCAGTR (SEQ ID NO: 13381) |
| 73 | RG + CYATAGKWCAGTR (SEQ ID NO: 13382) |
| 73 | +RGCYATAGKWCAGTR (SEQ ID NO: 13383) |
| 73 | RGC + YATAGKWCAGTR (SEQ ID NO: 13384) |
| 73 | RGCYAT + AGKWCAGTR (SEQ ID NO: 13385) |
| 73 | RGCYATAGKWCAGTRY (SEQ ID NO: 13386) |
| 73 | RGCYATAG + KWCAGTR (SEQ ID NO: 13387) |
| 73 | RGCYATAGKWC + AGTR (SEQ ID NO: 13388) |
| 73 | RGCYATAGK + WCAGTR (SEQ ID NO: 13389) |
| 73 | RGCYAT + A + G + KWCAGTR (SEQ ID NO: 13390) |
| 73 | RGCY + ATA + G + KWCAGTR (SEQ ID NO: 13391) |
| 73 | R + GCYATA + G + KWCAGTR (SEQ ID NO: 13392) |
| 73 | RG + CYATA + G + KWCAGTR (SEQ ID NO: 13393) |
| 73 | RGCYATA + G + KWC + AGTR (SEQ ID NO: 13394) |
| 73 | RGCYATA + G + K + WCAGTR (SEQ ID NO: 13395) |

TABLE 10 -continued

| | |
|---|---|
| 73 | RGCYATA + G + KWCAGTR (SEQ ID NO: 13396) |
| 73 | RGCYATA + G + KW + CAGTR (SEQ ID NO: 13397) |
| 73 | RRGCYAT + A + GKWCAGT (SEQ ID NO: 13398) |
| 73 | RRGCYA + TAGKWCAGT (SEQ ID NO: 13399) |
| 73 | +RRGCYATAGKWCAGT (SEQ ID NO: 13400) |
| 73 | R + RGCYATAGKWCAGT (SEQ ID NO: 13401) |
| 73 | RRG + CYATAGKWCAGT (SEQ ID NO: 13402) |
| 73 | RRGCYATAGKWC + AGT (SEQ ID NO: 13403) |
| 73 | RRGCYATAGK + WCAGT (SEQ ID NO: 13404) |
| 73 | RRGCYATAG + KWCAGT (SEQ ID NO: 13405) |
| 73 | RRGCYATAGKWCAGTR (SEQ ID NO: 13406) |
| 73 | RRGCYA + T + A + GKWCAGT (SEQ ID NO: 13407) |
| 73 | RRG + CYAT + A + GKWCAGT (SEQ ID NO: 13408) |
| 73 | +RRGCYAT + A + GKWCAGT (SEQ ID NO: 13409) |
| 73 | RRGCY + AT + A + GKWCAGT (SEQ ID NO: 13410) |
| 73 | RRGCYAT + A + GKWC + AGT (SEQ ID NO: 13411) |
| 73 | RRGCYAT + A + GKWCAGTR (SEQ ID NO: 13412) |
| 73 | RRGCYAT + A + GKW + CAGT (SEQ ID NO: 13413) |
| 73 | RRGCYAT + A + GK + WCAGT (SEQ ID NO: 13414) |
| 73 | TACTGTRCTTATAGC (SEQ ID NO: 13415) |
| 73 | TACTGTNGTTATAGC (SEQ ID NO: 13416) |
| 73 | TACTGTRCATATAGC (SEQ ID NO: 13417) |
| 73 | TACTGTNGCTATAGC (SEQ ID NO: 13418) |
| 73 | RRGCYATAGKWCAGTRYTR (SEQ ID NO: 13419) |
| 73 | ARRGCYATAGKWCAGTRYT (SEQ ID NO: 13420) |
| 73 | RRGCYATAGKWCAGTRYT (SEQ ID NO: 13421) |
| 73 | ARRGCYATAGKWCAGTRY (SEQ ID NO: 13422) |
| 73 | RGCYATAGKWCAGTRYT (SEQ ID NO: 13423) |
| 73 | RRGCYATAGKWCAGTRY (SEQ ID NO: 13424) |
| 73 | RGCYATAGKWCAGTR (SEQ ID NO: 13425) |
| 73 | RRGCYATAGKWCAGT (SEQ ID NO: 13426) |
| 74 | GCYATAGG + K + CAGTRYTRRT (SEQ ID NO: 13427) |
| 74 | GCYATAG + GKCAGTRYTRRT (SEQ ID NO: 13428) |
| 74 | GCY + ATAGGKCAGTRYTRRT (SEQ ID NO: 13429) |
| 74 | GC + YATAGGKCAGTRYTRRT (SEQ ID NO: 13430) |
| 74 | GCYATAGG + KCAGTRYTRRT (SEQ ID NO: 13431) |
| 74 | GCYATAGGKCA + GTRYTRRT (SEQ ID NO: 13432) |
| 74 | GCYATAGGKCAGTRYTR + RT (SEQ ID NO: 13433) |
| 74 | GCYATAGGK + CAGTRYTRRT (SEQ ID NO: 13434) |
| 74 | GCYATAGGKCAGTRYT + RRT (SEQ ID NO: 13435) |

TABLE 10 -continued

| | |
|---|---|
| 74 | GC + YATAGG + K + CAGTRYTRRT (SEQ ID NO: 13436) |
| 74 | GCYATA + GG + K + CAGTRYTRRT (SEQ ID NO: 13437) |
| 74 | GCY + ATAGG + K + CAGTRYTRRT (SEQ ID NO: 13438) |
| 74 | GCYA + TAGG + K + CAGTRYTRRT (SEQ ID NO: 13439) |
| 74 | GCYATAGG + K + CAGTRYTR + RT (SEQ ID NO: 13440) |
| 74 | GCYATAGG + K + CAG + TRYTRRT (SEQ ID NO: 13441) |
| 74 | GCYATAGG + K + CAGT + RYTRRT (SEQ ID NO: 13442) |
| 74 | GCYATAGG + K + C + AGTRYTRRT (SEQ ID NO: 13443) |
| 74 | GCYATAGG + K + CAGTRYTRR (SEQ ID NO: 13444) |
| 74 | GCYATAG + GKCAGTRYTRR (SEQ ID NO: 13445) |
| 74 | GCY + ATAGGKCAGTRYTRR (SEQ ID NO: 13446) |
| 74 | GC + YATAGGKCAGTRYTRR (SEQ ID NO: 13447) |
| 74 | GCYATAGG + KCAGTRYTRR (SEQ ID NO: 13448) |
| 74 | GCYATAGGKCA + GTRYTRR (SEQ ID NO: 13449) |
| 74 | GCYATAGGKCAGTRYTR + R (SEQ ID NO: 13450) |
| 74 | GCYATAGGK + CAGTRYTRR (SEQ ID NO: 13451) |
| 74 | GCYATAGGKCAGTRYT + RR (SEQ ID NO: 13452) |
| 74 | GC + YATAGG + K + CAGTRYTRR (SEQ ID NO: 13453) |
| 74 | GCYATA + GG + K + CAGTRYTRR (SEQ ID NO: 13454) |
| 74 | GCY + ATAGG + K + CAGTRYTRR (SEQ ID NO: 13455) |
| 74 | GCYA + TAGG + K + CAGTRYTRR (SEQ ID NO: 13456) |
| 74 | GCYATAGG + K + CAGTRYTR + R (SEQ ID NO: 13457) |
| 74 | GCYATAGG + K + CAG + TRYTRR (SEQ ID NO: 13458) |
| 74 | GCYATAGG + K + CAGT + RYTRR (SEQ ID NO: 13459) |
| 74 | GCYATAGG + K + C + AGTRYTRR (SEQ ID NO: 13460) |
| 74 | CYATAGG + K + CAGTRYTRR (SEQ ID NO: 13461) |
| 74 | CYATAG + GKCAGTRYTRR (SEQ ID NO: 13462) |
| 74 | CY + ATAGGKCAGTRYTRR (SEQ ID NO: 13463) |
| 74 | C + YATAGGKCAGTRYTRR (SEQ ID NO: 13464) |
| 74 | CYATAGG + KCAGTRYTRR (SEQ ID NO: 13465) |
| 74 | CYATAGGKCA + GTRYTRR (SEQ ID NO: 13466) |
| 74 | CYATAGGKCAGTRYTR + R (SEQ ID NO: 13467) |
| 74 | CYATAGGK + CAGTRYTRR (SEQ ID NO: 13468) |
| 74 | CYATAGGKCAGTRYT + RR (SEQ ID NO: 13469) |
| 74 | C + YATAGG + K + CAGTRYTRR (SEQ ID NO: 13470) |
| 74 | CYATA + GG + K + CAGTRYTRR (SEQ ID NO: 13471) |
| 74 | CY + ATAGG + K + CAGTRYTRR (SEQ ID NO: 13472) |
| 74 | CYA + TAGG + K + CAGTRYTRR (SEQ ID NO: 13473) |
| 74 | CYATAGG + K + CAGTRYTR + R (SEQ ID NO: 13474) |
| 74 | CYATAGG + K + CAG + TRYTRR (SEQ ID NO: 13475) |

TABLE 10 -continued

| | |
|---|---|
| 74 | CYATAGG + K + CAGT + RYTRR (SEQ ID NO: 13476) |
| 74 | CYATAGG + K + C + AGTRYTRR (SEQ ID NO: 13477) |
| 74 | CYATAGG + K + CAGTRYT (SEQ ID NO: 13478) |
| 74 | CYATAG + GKCAGTRYT (SEQ ID NO: 13479) |
| 74 | CY + ATAGGKCAGTRYT (SEQ ID NO: 13480) |
| 74 | C + YATAGGKCAGTRYT (SEQ ID NO: 13481) |
| 74 | CYATAGG + KCAGTRYT (SEQ ID NO: 13482) |
| 74 | CYATAGGKCA + GTRYT (SEQ ID NO: 13483) |
| 74 | CYATAGGKCAGTRYTR (SEQ ID NO: 13484) |
| 74 | CYATAGGK + CAGTRYT (SEQ ID NO: 13485) |
| 74 | CYATAGGKCAGTRYT (SEQ ID NO: 13486) |
| 74 | C + YATAGG + K + CAGTRYT (SEQ ID NO: 13487) |
| 74 | CYATA + GG + K + CAGTRYT (SEQ ID NO: 13488) |
| 74 | CY + ATAGG + K + CAGTRYT (SEQ ID NO: 13489) |
| 74 | CYA + TAGG + K + CAGTRYT (SEQ ID NO: 13490) |
| 74 | CYATAGG + K + CAGTRYTR (SEQ ID NO: 13491) |
| 74 | CYATAGG + K + CAG + TRYT (SEQ ID NO: 13492) |
| 74 | CYATAGG + K + CAGT + RYT (SEQ ID NO: 13493) |
| 74 | CYATAGG + K + C + AGTRYT (SEQ ID NO: 13494) |
| 74 | ATAGGTCCRGTATTA (SEQ ID NO: 13495) |
| 74 | GCYATAGGKCAGTRYTRRT (SEQ ID NO: 13496) |
| 74 | GCYATAGGKCAGTRYTRR (SEQ ID NO: 13497) |
| 74 | CYATAGGKCAGTRYTRR (SEQ ID NO: 13498) |
| 74 | CYATAGGKCAGTRYT (SEQ ID NO: 13499) |
| 76 | GGKWCAGT + R + TRRTRGGRCC (SEQ ID NO: 13500) |
| 76 | GGKWCA + GTRTRRTRGGRCC (SEQ ID NO: 13501) |
| 76 | GGK + WCAGTRTRRTRGGRCC (SEQ ID NO: 13502) |
| 76 | GGKWCAGT + RTRRTRGGRCC (SEQ ID NO: 13503) |
| 76 | G + GKWCAGTRTRRTRGGRCC (SEQ ID NO: 13504) |
| 76 | GGKWCAGTRTRRTRGGR + CC (SEQ ID NO: 13505) |
| 76 | GGKWCAGTRTRRT + RGGRCC (SEQ ID NO: 13506) |
| 76 | GGKWCAGTRTR + RTRGGRCC (SEQ ID NO: 13507) |
| 76 | GGKWCAGTR + TRRTRGGRCC (SEQ ID NO: 13508) |
| 76 | GGKW + CAGT + R + TRRTRGGRCC (SEQ ID NO: 13509) |
| 76 | GG + KWCAGT + R + TRRTRGGRCC (SEQ ID NO: 13510) |
| 76 | GGKWC + AGT + R + TRRTRGGRCC (SEQ ID NO: 13511) |
| 76 | G + GKWCAGT + R + TRRTRGGRCC (SEQ ID NO: 13512) |
| 76 | GGKWCAGT + R + T + RRTRGGRCC (SEQ ID NO: 13513) |
| 76 | GGKWCAGT + R + TRR + TRGGRCC (SEQ ID NO: 13514) |
| 76 | GGKWCAGT + R + TRRT + RGGRCC (SEQ ID NO: 13515) |

TABLE 10 -continued

| | |
|---|---|
| 76 | GGKWCAGT + R + TRRTR + GGRCC (SEQ ID NO: 13516) |
| 76 | GGKWCAGT + R + TRRTRGGRC (SEQ ID NO: 13517) |
| 76 | GGKWCA + GTRTRRTRGGRC (SEQ ID NO: 13518) |
| 76 | GGK + WCAGTRTRRTRGGRC (SEQ ID NO: 13519) |
| 76 | GGKWCAGT + RTRRTRGGRC (SEQ ID NO: 13520) |
| 76 | G + GKWCAGTRTRRTRGGRC (SEQ ID NO: 13521) |
| 76 | GGKWCAGTRTRRTRGGR + C (SEQ ID NO: 13522) |
| 76 | GGKWCAGTRTRRT + RGGRC (SEQ ID NO: 13523) |
| 76 | GGKWCAGTRTR + RTGGRC (SEQ ID NO: 13524) |
| 76 | GGKWCAGTR + TRRTRGGRC (SEQ ID NO: 13525) |
| 76 | GGKW + CAGT + R + TRRTRGGRC (SEQ ID NO: 13526) |
| 76 | GG + KWCAGT + R + TRRTRGGRC (SEQ ID NO: 13527) |
| 76 | GGKWC + AGT + R + TRRTRGGRC (SEQ ID NO: 13528) |
| 76 | G + GKWCAGT + R + TRRTRGGRC (SEQ ID NO: 13529) |
| 76 | GGKWCAGT + R + T + RRTRGGRC (SEQ ID NO: 13530) |
| 76 | GGKWCAGT + R + TRR + TRGGRC (SEQ ID NO: 13531) |
| 76 | GGKWCAGT + R + TRRT + RGGRC (SEQ ID NO: 13532) |
| 76 | GGKWCAGT + R + TRRTR + GGRC (SEQ ID NO: 13533) |
| 76 | GKWCAGT + R + TRRTRGGRC (SEQ ID NO: 13534) |
| 76 | GKWCA + GTRTRRTRGGRC (SEQ ID NO: 13535) |
| 76 | GK + WCAGTRTRRTRGGRC (SEQ ID NO: 13536) |
| 76 | GKWCAGT + RTRRTRGGRC (SEQ ID NO: 13537) |
| 76 | +GKWCAGTRTRRTRGGRC (SEQ ID NO: 13538) |
| 76 | GKWCAGTRTRRTRGGR + C (SEQ ID NO: 13539) |
| 76 | GKWCAGTRTRRT + RGGRC (SEQ ID NO: 13540) |
| 76 | GKWCAGTRTR + RTGGRC (SEQ ID NO: 13541) |
| 76 | GKWCAGTR + TRRTRGGRC (SEQ ID NO: 13542) |
| 76 | GKW + CAGT + R + TRRTRGGRC (SEQ ID NO: 13543) |
| 76 | G + KWCAGT + R + TRRTRGGRC (SEQ ID NO: 13544) |
| 76 | GKWC + AGT + R + TRRTRGGRC (SEQ ID NO: 13545) |
| 76 | +GKWCAGT + R + TRRTRGGRC (SEQ ID NO: 13546) |
| 76 | GKWCAGT + R + T + RRTRGGRC (SEQ ID NO: 13547) |
| 76 | GKWCAGT + R + TRR + TRGGRC (SEQ ID NO: 13548) |
| 76 | GKWCAGT + R + TRRT + RGGRC (SEQ ID NO: 13549) |
| 76 | GKWCAGT + R + TRRTR + GGRC (SEQ ID NO: 13550) |
| 76 | GKWCAGT + R + TRRTRGG (SEQ ID NO: 13551) |
| 76 | GKWCA + GTRTRRTRGG (SEQ ID NO: 13552) |
| 76 | GK + WCAGTRTRRTRGG (SEQ ID NO: 13553) |
| 76 | GKWCAGT + RTRRTRGG (SEQ ID NO: 13554) |
| 76 | +GKWCAGTRTRRTRGG (SEQ ID NO: 13555) |

TABLE 10 -continued

| | |
|---|---|
| 76 | GKWCAGTRTRRTRGGR (SEQ ID NO: 13556) |
| 76 | GKWCAGTRTRRT + RGG (SEQ ID NO: 13557) |
| 76 | GKWCAGTRTR + RTRGG (SEQ ID NO: 13558) |
| 76 | GKWCAGTR + TRRTRGG (SEQ ID NO: 13559) |
| 76 | GKW + CAGT + R + TRRTRGG (SEQ ID NO: 13560) |
| 76 | G + KWCAGT + R + TRRTRGG (SEQ ID NO: 13561) |
| 76 | GKWC + AGT + R + TRRTRGG (SEQ ID NO: 13562) |
| 76 | +GKWCAGT + R + TRRTRGG (SEQ ID NO: 13563) |
| 76 | GKWCAGT + R + T + RRTRGG (SEQ ID NO: 13564) |
| 76 | GKWCAGT + R + TRR + TRGG (SEQ ID NO: 13565) |
| 76 | GKWCAGT + R + TRRT + RGG (SEQ ID NO: 13566) |
| 76 | GKWCAGT + R + TRRTR + GG (SEQ ID NO: 13567) |
| 76 | ACAGTAGTRGTAGGA (SEQ ID NO: 13568) |
| 76 | GGKWCAGTRTRRTRGGRCC (SEQ ID NO: 13569) |
| 76 | GGKWCAGTRTRRTRGGRC (SEQ ID NO: 13570) |
| 76 | GKWCAGTRTRRTRGGRC (SEQ ID NO: 13571) |
| 76 | GKWCAGTRTRRTRGG (SEQ ID NO: 13572) |
| 82 | CYACACCT + R + CAACATAATT (SEQ ID NO: 13573) |
| 82 | CYACA + CCTRCAACATAATT (SEQ ID NO: 13574) |
| 82 | CYA + CACCTRCAACATAATT (SEQ ID NO: 13575) |
| 82 | CYACAC + CTRCAACATAATT (SEQ ID NO: 13576) |
| 82 | CYACACCT + RCAACATAATT (SEQ ID NO: 13577) |
| 82 | CYACACCTRCAACAT + AATT (SEQ ID NO: 13578) |
| 82 | CYACACCTRCAACA + TAATT (SEQ ID NO: 13579) |
| 82 | CYACACCTRCAACATAA + TT (SEQ ID NO: 13580) |
| 82 | CYACACCTRCA + ACATAATT (SEQ ID NO: 13581) |
| 82 | CYAC + ACCT + R + CAACATAATT (SEQ ID NO: 13582) |
| 82 | CYA + CACCT + R + CAACATAATT (SEQ ID NO: 13583) |
| 82 | CYACACC + T + R + CAACATAATT (SEQ ID NO: 13584) |
| 82 | C + YACACCT + R + CAACATAATT (SEQ ID NO: 13585) |
| 82 | CYACACCT + R + CAAC + ATAATT (SEQ ID NO: 13586) |
| 82 | CYACACCT + R + CAACATAA + TT (SEQ ID NO: 13587) |
| 82 | CYACACCT + R + CAACA + TAATT (SEQ ID NO: 13588) |
| 82 | CYACACCT + R + CAA + CATAATT (SEQ ID NO: 13589) |
| 82 | CCYACACC + T + TCAACATAAT (SEQ ID NO: 13590) |
| 82 | CCYA + CACCTTCAACATAAT (SEQ ID NO: 13591) |
| 82 | CCYACACC + TTCAACATAAT (SEQ ID NO: 13592) |
| 82 | CC + YACACCTTCAACATAAT (SEQ ID NO: 13593) |
| 82 | CCYACAC + CTTCAACATAAT (SEQ ID NO: 13594) |
| 82 | CCYACACCTTCAA + CATAAT (SEQ ID NO: 13595) |

TABLE 10 -continued

| | |
|---|---|
| 82 | CCYACACCTTCAAC + ATAAT (SEQ ID NO: 13596) |
| 82 | CCYACACCTTCAACA + TAAT (SEQ ID NO: 13597) |
| 82 | CCYACACCTTC + AACATAAT (SEQ ID NO: 13598) |
| 82 | CCY + ACACC + T + TCAACATAAT (SEQ ID NO: 13599) |
| 82 | CC + YACACC + T + TCAACATAAT (SEQ ID NO: 13600) |
| 82 | C + CYACACC + T + TCAACATAAT (SEQ ID NO: 13601) |
| 82 | CCYACAC + C + T + TCAACATAAT (SEQ ID NO: 13602) |
| 82 | CCYACACC + T + TC + AACATAAT (SEQ ID NO: 13603) |
| 82 | CCYACACC + T + TCAAC + ATAAT (SEQ ID NO: 13604) |
| 82 | CCYACACC + T + TCA + ACATAAT (SEQ ID NO: 13605) |
| 82 | CCYACACC + T + TCAACAT + AAT (SEQ ID NO: 13606) |
| 82 | CYACACCT + R + CAACATAAT (SEQ ID NO: 13607) |
| 82 | CYACA + CCTRCAACATAAT (SEQ ID NO: 13608) |
| 82 | CYA + CACCTRCAACATAAT (SEQ ID NO: 13609) |
| 82 | CYACAC + CTRCAACATAAT (SEQ ID NO: 13610) |
| 82 | CYACACCT + RCAACATAAT (SEQ ID NO: 13611) |
| 82 | CYACACCTRCAACAT + AAT (SEQ ID NO: 13612) |
| 82 | CYACACCTRCAACA + TAAT (SEQ ID NO: 13613) |
| 82 | CYACACCTRCAACATAA + T (SEQ ID NO: 13614) |
| 82 | CYACACCTRCA + ACATAAT (SEQ ID NO: 13615) |
| 82 | CYAC + ACCT + R + CAACATAAT (SEQ ID NO: 13616) |
| 82 | CYA + CACCT + R + CAACATAAT (SEQ ID NO: 13617) |
| 82 | CYACACC + T + R + CAACATAAT (SEQ ID NO: 13618) |
| 82 | C + YACACCT + R + CAACATAAT (SEQ ID NO: 13619) |
| 82 | CYACACCT + R + CAAC + ATAAT (SEQ ID NO: 13620) |
| 82 | CYACACCT + R + CAACATAA + T (SEQ ID NO: 13621) |
| 82 | CYACACCT + R + CAACA + TAAT (SEQ ID NO: 13622) |
| 82 | CYACACCT + R + CAA + CATAT (SEQ ID NO: 13623) |
| 82 | CCYACACC + T + TCAACATAA (SEQ ID NO: 13624) |
| 82 | CCYA + CACCTTCAACATAA (SEQ ID NO: 13625) |
| 82 | CCYACACC + TTCAACATAA (SEQ ID NO: 13626) |
| 82 | CC + YACACCTTCAACATAA (SEQ ID NO: 13627) |
| 82 | CCYACAC + CTTCAACATAA (SEQ ID NO: 13628) |
| 82 | CCYACACCTTCAA + CATAA (SEQ ID NO: 13629) |
| 82 | CCYACACCTTCAAC + ATAA (SEQ ID NO: 13630) |
| 82 | CCYACACCTTCAACA + TAA (SEQ ID NO: 13631) |
| 82 | CCYACACCTTC + AACATAA (SEQ ID NO: 13632) |
| 82 | CCY + ACACC + T + TCAACATAA (SEQ ID NO: 13633) |
| 82 | CC + YACACC + T + TCAACATAA (SEQ ID NO: 13634) |
| 82 | C + CYACACC + T + TCAACATAA (SEQ ID NO: 13635) |

TABLE 10 -continued

| | |
|---|---|
| 82 | CCYACAC + C + T + TCAACATAA (SEQ ID NO: 13636) |
| 82 | CCYACACC + T + TC + AACATAA (SEQ ID NO: 13637) |
| 82 | CCYACACC + T + TCAAC + ATAA (SEQ ID NO: 13638) |
| 82 | CCYACACC + T + TCA + ACATAA (SEQ ID NO: 13639) |
| 82 | CCYACACC + T + TCAACAT + AA (SEQ ID NO: 13640) |
| 82 | YACACCT + R + CAACATAAT (SEQ ID NO: 13641) |
| 82 | YACA + CCTRCAACATAAT (SEQ ID NO: 13642) |
| 82 | YA + CACCTRCAACATAAT (SEQ ID NO: 13643) |
| 82 | YACAC + CTRCAACATAAT (SEQ ID NO: 13644) |
| 82 | YACACCT + RCAACATAAT (SEQ ID NO: 13645) |
| 82 | YACACCTRCAACAT + AAT (SEQ ID NO: 13646) |
| 82 | YACACCTRCAACA + TAAT (SEQ ID NO: 13647) |
| 82 | YACACCTRCAACATAA + T (SEQ ID NO: 13648) |
| 82 | YACACCTRCA + ACATAAT (SEQ ID NO: 13649) |
| 82 | YAC + ACCT + R + CAACATAAT (SEQ ID NO: 13650) |
| 82 | YA + CACCT + R + CAACATAAT (SEQ ID NO: 13651) |
| 82 | YACACC + T + R + CAACATAAT (SEQ ID NO: 13652) |
| 82 | +YACACCT + R + CAACATAAT (SEQ ID NO: 13653) |
| 82 | YACACCT + R + CAAC + ATAAT (SEQ ID NO: 13654) |
| 82 | YACACCT + R + CAACATAA + T (SEQ ID NO: 13655) |
| 82 | YACACCT + R + CAACA + TAAT (SEQ ID NO: 13656) |
| 82 | YACACCT + R + CAA + CATAAT (SEQ ID NO: 13657) |
| 82 | CYACACC + T + TCAACATAA (SEQ ID NO: 13658) |
| 82 | CYA + CACCTTCAACATAA (SEQ ID NO: 13659) |
| 82 | CYACACC + TTCAACATAA (SEQ ID NO: 13660) |
| 82 | C + YACACCTTCAACATAA (SEQ ID NO: 13661) |
| 82 | CYACAC + CTTCAACATAA (SEQ ID NO: 13662) |
| 82 | CYACACCTTCAA + CATAA (SEQ ID NO: 13663) |
| 82 | CYACACCTTCAAC + ATAA (SEQ ID NO: 13664) |
| 82 | CYACACCTTCAACA + TAA (SEQ ID NO: 13665) |
| 82 | CYACACCTTC + AACATAA (SEQ ID NO: 13666) |
| 82 | CY + ACACC + T + TCAACATAA (SEQ ID NO: 13667) |
| 82 | C + YACACC + T + TCAACATAA (SEQ ID NO: 13668) |
| 82 | +CYACACC + T + TCAACATAA (SEQ ID NO: 13669) |
| 82 | CYACAC + C + T + TCAACATAA (SEQ ID NO: 13670) |
| 82 | CYACACC + T + TC + AACATAA (SEQ ID NO: 13671) |
| 82 | CYACACC + T + TCAAC + ATAA (SEQ ID NO: 13672) |
| 82 | CYACACC + T + TCA + ACATAA (SEQ ID NO: 13673) |
| 82 | CYACACC + T + TCAACAT + AA (SEQ ID NO: 13674) |
| 82 | YACACCT + R + CAACATA (SEQ ID NO: 13675) |

TABLE 10 -continued

| | |
|---|---|
| 82 | YACA + CCTRCAACATA (SEQ ID NO: 13676) |
| 82 | YA + CACCTRCAACATA (SEQ ID NO: 13677) |
| 82 | YACAC + CTRCAACATA (SEQ ID NO: 13678) |
| 82 | YACACCT + RCAACATA (SEQ ID NO: 13679) |
| 82 | YACACCTRCAACAT + A (SEQ ID NO: 13680) |
| 82 | YACACCTRCAACA + TA (SEQ ID NO: 13681) |
| 82 | YACACCTRCAACATAA (SEQ ID NO: 13682) |
| 82 | YACACCTRCA + ACATA (SEQ ID NO: 13683) |
| 82 | YAC + ACCT + R + CAACATA (SEQ ID NO: 13684) |
| 82 | YA + CACCT + R + CAACATA (SEQ ID NO: 13685) |
| 82 | YACACC + T + R + CAACATA (SEQ ID NO: 13686) |
| 82 | +YACACCT + R + CAACATA (SEQ ID NO: 13687) |
| 82 | YACACCT + R + CAAC + ATA (SEQ ID NO: 13688) |
| 82 | YACACCT + R + CAACATAA (SEQ ID NO: 13689) |
| 82 | YACACCT + R + CAACA + TA (SEQ ID NO: 13690) |
| 82 | YACACCT + R + CAA + CATA (SEQ ID NO: 13691) |
| 82 | CYACACC + T + TCAACAT (SEQ ID NO: 13692) |
| 82 | CYA + CACCTTCAACAT (SEQ ID NO: 13693) |
| 82 | CYACACC + TTCAACAT (SEQ ID NO: 13694) |
| 82 | C + YACACCTTCAACAT (SEQ ID NO: 13695) |
| 82 | CYACAC + CTTCAACAT (SEQ ID NO: 13696) |
| 82 | CYACACCTTCAA + CAT (SEQ ID NO: 13697) |
| 82 | CYACACCTTCAAC + AT (SEQ ID NO: 13698) |
| 82 | CYACACCTTCAACA + T (SEQ ID NO: 13699) |
| 82 | CYACACCTTC + AACAT (SEQ ID NO: 13700) |
| 82 | CY + ACACC + T + TCAACAT (SEQ ID NO: 13701) |
| 82 | C + YACACC + T + TCAACAT (SEQ ID NO: 13702) |
| 82 | +CYACACC + T + TCAACAT (SEQ ID NO: 13703) |
| 82 | CYACAC + C + T + TCAACAT (SEQ ID NO: 13704) |
| 82 | CYACACC + T + TC + AACAT (SEQ ID NO: 13705) |
| 82 | CYACACC + T + TCAAC + AT (SEQ ID NO: 13706) |
| 82 | CYACACC + T + TCA + ACAT (SEQ ID NO: 13707) |
| 82 | CYACACC + T + TCAACAT (SEQ ID NO: 13708) |
| 82 | ACACCTGCYAACATA (SEQ ID NO: 13709) |
| 82 | ACACCTACYAACATA (SEQ ID NO: 13710) |
| 82 | ACACCTAGYAACATA (SEQ ID NO: 13711) |
| 82 | ACACCTTTYAACATA (SEQ ID NO: 13712) |
| 82 | ACACCTCTYAACATA (SEQ ID NO: 13713) |
| 82 | ACACCTTGYAACATA (SEQ ID NO: 13714) |
| 82 | ACACCTATGAACATA (SEQ ID NO: 13715) |

TABLE 10 -continued

| | | |
|---|---|---|
| 82 | CYACACCTRCAACATAATT | (SEQ ID NO: 13716) |
| 82 | CCYACACCTTCAACATAAT | (SEQ ID NO: 13717) |
| 82 | CYACACCTRCAACATAAT | (SEQ ID NO: 13718) |
| 82 | CCYACACCTTCAACATAA | (SEQ ID NO: 13719) |
| 82 | YACACCTRCAACATAAT | (SEQ ID NO: 13720) |
| 82 | CYACACCTTCAACATAA | (SEQ ID NO: 13721) |
| 82 | YACACCTRCAACATA | (SEQ ID NO: 13722) |
| 82 | CYACACCTTCAACAT | (SEQ ID NO: 13723) |
| 83 | ACACCTRT + C + ACATAATTGG | (SEQ ID NO: 13724) |
| 83 | ACAC + CTRTCACATAATTGG | (SEQ ID NO: 13725) |
| 83 | AC + ACCTRTCACATAATTGG | (SEQ ID NO: 13726) |
| 83 | ACACC + TRTCACATAATTGG | (SEQ ID NO: 13727) |
| 83 | ACACCTRT + CACATAATTGG | (SEQ ID NO: 13728) |
| 83 | ACACCTRTCACATA + ATTGG | (SEQ ID NO: 13729) |
| 83 | ACACCTRTCACATAA + TTGG | (SEQ ID NO: 13730) |
| 83 | ACACCTRTCA + CATAATTGG | (SEQ ID NO: 13731) |
| 83 | ACACCTRTCACAT + AATTGG | (SEQ ID NO: 13732) |
| 83 | AC + ACCTRT + C + ACATAATTGG | (SEQ ID NO: 13733) |
| 83 | ACACCT + RT + C + ACATAATTGG | (SEQ ID NO: 13734) |
| 83 | A + CACCTRT + C + ACATAATTGG | (SEQ ID NO: 13735) |
| 83 | ACACC + TRT + C + ACATAATTGG | (SEQ ID NO: 13736) |
| 83 | ACACCTRT + C + ACATAAT + TGG | (SEQ ID NO: 13737) |
| 83 | ACACCTRT + C + ACA + TAATTGG | (SEQ ID NO: 13738) |
| 83 | ACACCTRT + C + ACATAATT + GG | (SEQ ID NO: 13739) |
| 83 | ACACCTRT + C + A + CATAATTGG | (SEQ ID NO: 13740) |
| 83 | ACACCTRT + C + ACATAATTG | (SEQ ID NO: 13741) |
| 83 | ACAC + CTRTCACATAATTG | (SEQ ID NO: 13742) |
| 83 | AC + ACCTRTCACATAATTG | (SEQ ID NO: 13743) |
| 83 | ACACC + TRTCACATAATTG | (SEQ ID NO: 13744) |
| 83 | ACACCTRT + CACATAATTG | (SEQ ID NO: 13745) |
| 83 | ACACCTRTCACATA + ATTG | (SEQ ID NO: 13746) |
| 83 | ACACCTRTCACATAA + TTG | (SEQ ID NO: 13747) |
| 83 | ACACCTRTCA + CATAATTG | (SEQ ID NO: 13748) |
| 83 | ACACCTRTCACAT + AATTG | (SEQ ID NO: 13749) |
| 83 | AC + ACCTRT + C + ACATAATTG | (SEQ ID NO: 13750) |
| 83 | ACACCT + RT + C + ACATAATTG | (SEQ ID NO: 13751) |
| 83 | A + CACCTRT + C + ACATAATTG | (SEQ ID NO: 13752) |
| 83 | ACACC + TRT + C + ACATAATTG | (SEQ ID NO: 13753) |
| 83 | ACACCTRT + C + ACATAAT + TG | (SEQ ID NO: 13754) |
| 83 | ACACCTRT + C + ACA + TAATTG | (SEQ ID NO: 13755) |

TABLE 10 -continued

| 83 | ACACCTRT + C + ACATAATT + G (SEQ ID NO: 13756) |
| 83 | ACACCTRT + C + A + CATAATTG (SEQ ID NO: 13757) |
| 83 | CACCTRT + C + ACATAATTG (SEQ ID NO: 13758) |
| 83 | CAC + CTRTCACATAATTG (SEQ ID NO: 13759) |
| 83 | C + ACCTRTCACATAATTG (SEQ ID NO: 13760) |
| 83 | CACC + TRTCACATAATTG (SEQ ID NO: 13761) |
| 83 | CACCTRT + CACATAATTG (SEQ ID NO: 13762) |
| 83 | CACCTRTCACATA + ATTG (SEQ ID NO: 13763) |
| 83 | CACCTRTCACATAA + TTG (SEQ ID NO: 13764) |
| 83 | CACCTRTCA + CATAATTG (SEQ ID NO: 13765) |
| 83 | CACCTRTCACAT + AATTG (SEQ ID NO: 13766) |
| 83 | C + ACCTRT + C + ACATAATTG (SEQ ID NO: 13767) |
| 83 | CACCT + RT + C + ACATAATTG (SEQ ID NO: 13768) |
| 83 | +CACCTRT + C + ACATAATTG (SEQ ID NO: 13769) |
| 83 | CACC + TRT + C + ACATAATTG (SEQ ID NO: 13770) |
| 83 | CACCTRT + C + ACATAAT + TG (SEQ ID NO: 13771) |
| 83 | CACCTRT + C + ACA + TAATTG (SEQ ID NO: 13772) |
| 83 | CACCTRT + C + ACATAATT + G (SEQ ID NO: 13773) |
| 83 | CACCTRT + C + A + CATAATTG (SEQ ID NO: 13774) |
| 83 | CACCTRT + C + ACATAAT (SEQ ID NO: 13775) |
| 83 | CAC + CTRTCACATAAT (SEQ ID NO: 13776) |
| 83 | C + ACCTRTCACATAAT (SEQ ID NO: 13777) |
| 83 | CACC + TRTCACATAAT (SEQ ID NO: 13778) |
| 83 | CACCTRT + CACATAAT (SEQ ID NO: 13779) |
| 83 | CACCTRTCACATA + AT (SEQ ID NO: 13780) |
| 83 | CACCTRTCACATAA + T (SEQ ID NO: 13781) |
| 83 | CACCTRTCA + CATAAT (SEQ ID NO: 13782) |
| 83 | CACCTRTCACAT + AAT (SEQ ID NO: 13783) |
| 83 | C + ACCTRT + C + ACATAAT (SEQ ID NO: 13784) |
| 83 | CACCT + RT + C + ACATAAT (SEQ ID NO: 13785) |
| 83 | +CACCTRT + C + ACATAAT (SEQ ID NO: 13786) |
| 83 | CACC + TRT + C + ACATAAT (SEQ ID NO: 13787) |
| 83 | CACCTRT + C + ACATAAT (SEQ ID NO: 13788) |
| 83 | CACCTRT + C + ACA + TAAT (SEQ ID NO: 13789) |
| 83 | CACCTRT + C + ACATAATT (SEQ ID NO: 13790) |
| 83 | CACCTRT + C + A + CATAAT (SEQ ID NO: 13791) |
| 83 | ACCTGTCGAYATAAT (SEQ ID NO: 13792) |
| 83 | ACACCTRTCACATAATTGG (SEQ ID NO: 13793) |
| 83 | ACACCTRTCACATAATTG (SEQ ID NO: 13794) |
| 83 | CACCTRTCACATAATTG (SEQ ID NO: 13795) |

TABLE 10 -continued

| | |
|---|---|
| 83 | CACCTRTCACATAAT (SEQ ID NO: 13796) |
| 83 | CACCTRTCACATAATT (SEQ ID NO: 13797) |
| 84 | CCTRTCAA + C + TAATTGGRMG (SEQ ID NO: 13798) |
| 84 | C + CTRTCAACTAATTGGRMG (SEQ ID NO: 13799) |
| 84 | CC + TRTCAACTAATTGGRMG (SEQ ID NO: 13800) |
| 84 | CCTRTCAA + CTAATTGGRMG (SEQ ID NO: 13801) |
| 84 | CCTR + TCAACTAATTGGRMG (SEQ ID NO: 13802) |
| 84 | CCTRTCAACTAAT + TGGRMG (SEQ ID NO: 13803) |
| 84 | CCTRTCAACTAATTGGR + MG (SEQ ID NO: 13804) |
| 84 | CCTRTCAACT + AATTGGRMG (SEQ ID NO: 13805) |
| 84 | CCTRTCAACTA + ATTGGRMG (SEQ ID NO: 13806) |
| 84 | CCTRTC + AA + C + TAATTGGRMG (SEQ ID NO: 13807) |
| 84 | CCTRT + CAA + C + TAATTGGRMG (SEQ ID NO: 13808) |
| 84 | CC + TRTCAA + C + TAATTGGRMG (SEQ ID NO: 13809) |
| 84 | CCTR + TCAA + C + TAATTGGRMG (SEQ ID NO: 13810) |
| 84 | CCTRTCAA + C + TAATTG + GRMG (SEQ ID NO: 13811) |
| 84 | CCTRTCAA + C + T + AATTGGRMG (SEQ ID NO: 13812) |
| 84 | CCTRTCAA + C + TAAT + TGGRMG (SEQ ID NO: 13813) |
| 84 | CCTRTCAA + C + TAATTGGR + MG (SEQ ID NO: 13814) |
| 84 | CCTRTCAA + C + TAATTGGRM (SEQ ID NO: 13815) |
| 84 | C + CTRTCAACTAATTGGRM (SEQ ID NO: 13816) |
| 84 | CC + TRTCAACTAATTGGRM (SEQ ID NO: 13817) |
| 84 | CCTRTCAA + CTAATTGGRM (SEQ ID NO: 13818) |
| 84 | CCTR + TCAACTAATTGGRM (SEQ ID NO: 13819) |
| 84 | CCTRTCAACTAAT + TGGRM (SEQ ID NO: 13820) |
| 84 | CCTRTCAACTAATTGGR + M (SEQ ID NO: 13821) |
| 84 | CCTRTCAACT + AATTGGRM (SEQ ID NO: 13822) |
| 84 | CCTRTCAACTA + ATTGGRM (SEQ ID NO: 13823) |
| 84 | CCTRTC + AA + C + TAATTGGRM (SEQ ID NO: 13824) |
| 84 | CCTRT + CAA + C + TAATTGGRM (SEQ ID NO: 13825) |
| 84 | CC + TRTCAA + C + TAATTGGRM (SEQ ID NO: 13826) |
| 84 | CCTR + TCAA + C + TAATTGGRM (SEQ ID NO: 13827) |
| 84 | CCTRTCAA + C + TAATTG + GRM (SEQ ID NO: 13828) |
| 84 | CCTRTCAA + C + T + AATTGGRM (SEQ ID NO: 13829) |
| 84 | CCTRTCAA + C + TAAT + TGGRM (SEQ ID NO: 13830) |
| 84 | CCTRTCAA + C + TAATTGGR + M (SEQ ID NO: 13831) |
| 84 | CTRTCAA + C + TAATTGGRM (SEQ ID NO: 13832) |
| 84 | +CTRTCAACTAATTGGRM (SEQ ID NO: 13833) |
| 84 | C + TRTCAACTAATTGGRM (SEQ ID NO: 13834) |
| 84 | CTRTCAA + CTAATTGGRM (SEQ ID NO: 13835) |

TABLE 10 -continued

| | |
|---|---|
| 84 | CTR + TCAACTAATTGGRM (SEQ ID NO: 13836) |
| 84 | CTRTCAACTAAT + TGGRM (SEQ ID NO: 13837) |
| 84 | CTRTCAACTAATTGGR + M (SEQ ID NO: 13838) |
| 84 | CTRTCAACT + AATTGGRM (SEQ ID NO: 13839) |
| 84 | CTRTCAACTA + ATTGGRM (SEQ ID NO: 13840) |
| 84 | CTRTC + AA + C + TAATTGGRM (SEQ ID NO: 13841) |
| 84 | CTRT + CAA + C + TAATTGGRM (SEQ ID NO: 13842) |
| 84 | C + TRTCAA + C + TAATTGGRM (SEQ ID NO: 13843) |
| 84 | CTR + TCAA + C + TAATTGGRM (SEQ ID NO: 13844) |
| 84 | CTRTCAA + C + TAATTG + GRM (SEQ ID NO: 13845) |
| 84 | CTRTCAA + C + T + AATTGGRM (SEQ ID NO: 13846) |
| 84 | CTRTCAA + C + TAAT + TGGRM (SEQ ID NO: 13847) |
| 84 | CTRTCAA + C + TAATTGGR + M (SEQ ID NO: 13848) |
| 84 | CTRTCAA + C + TAATTGG (SEQ ID NO: 13849) |
| 84 | +CTRTCAACTAATTGG (SEQ ID NO: 13850) |
| 84 | C + TRTCAACTAATTGG (SEQ ID NO: 13851) |
| 84 | CTRTCAA + CTAATTGG (SEQ ID NO: 13852) |
| 84 | CTR + TCAACTAATTGG (SEQ ID NO: 13853) |
| 84 | CTRTCAACTAAT + TGG (SEQ ID NO: 13854) |
| 84 | CTRTCAACTAATTGGR (SEQ ID NO: 13855) |
| 84 | CTRTCAACT + AATTGG (SEQ ID NO: 13856) |
| 84 | CTRTCAACTA + ATTGG (SEQ ID NO: 13857) |
| 84 | CTRTC + AA + C + TAATTGG (SEQ ID NO: 13858) |
| 84 | CTRT + CAA + C + TAATTGG (SEQ ID NO: 13859) |
| 84 | C + TRTCAA + C + TAATTGG (SEQ ID NO: 13860) |
| 84 | CTR + TCAA + C + TAATTGG (SEQ ID NO: 13861) |
| 84 | CTRTCAA + C + TAATTG + G (SEQ ID NO: 13862) |
| 84 | CTRTCAA + C + T + AATTGG (SEQ ID NO: 13863) |
| 84 | CTRTCAA + C + TAAT + TGG (SEQ ID NO: 13864) |
| 84 | CTRTCAA + C + TAATTGGR (SEQ ID NO: 13865) |
| 84 | TCCAATTACGTTGAC (SEQ ID NO: 13866) |
| 84 | TCCAATTGCGTTGAC (SEQ ID NO: 13867) |
| 84 | TCCAATRCAGTTGAC (SEQ ID NO: 13868) |
| 84 | CCTRTCAACTAATTGGRMG (SEQ ID NO: 13869) |
| 84 | CCTRTCAACTAATTGGRM (SEQ ID NO: 13870) |
| 84 | CTRTCAACTAATTGGRM (SEQ ID NO: 13871) |
| 84 | CTRTCAACTAATTGG (SEQ ID NO: 13872) |
| 88 | TTGGRMGR + A + YHTGTTGACY (SEQ ID NO: 13873) |
| 88 | T + TGGRMGRAYHTGTTGACY (SEQ ID NO: 13874) |
| 88 | TTGG + RMGRAYHTGTTGACY (SEQ ID NO: 13875) |

TABLE 10 -continued

| | | |
|---|---|---|
| 88 | TTG + GRMGRAYHTGTTGACY | (SEQ ID NO: 13876) |
| 88 | TT + GGRMGRAYHTGTTGACY | (SEQ ID NO: 13877) |
| 88 | TTGGRMGRAYHTGTTGA + CY | (SEQ ID NO: 13878) |
| 88 | TTGGRMGRAYHTGTT + GACY | (SEQ ID NO: 13879) |
| 88 | TTGGRMGRAYHTG + TTGACY | (SEQ ID NO: 13880) |
| 88 | TTGGRMGRAYH + TGTTGACY | (SEQ ID NO: 13881) |
| 88 | TTGGRM + GR + A + YHTGTTGACY | (SEQ ID NO: 13882) |
| 88 | TT + GGRMGR + A + YHTGTTGACY | (SEQ ID NO: 13883) |
| 88 | TTGGRMG + R + A + YHTGTTGACY | (SEQ ID NO: 13884) |
| 88 | TTGGR + MGR + A + YHTGTTGACY | (SEQ ID NO: 13885) |
| 88 | TTGGRMGR + A + YHTGTTGA + CY | (SEQ ID NO: 13886) |
| 88 | TTGGRMGR + A + Y + HTGTTGACY | (SEQ ID NO: 13887) |
| 88 | TTGGRMGR + A + YHTG + TTGACY | (SEQ ID NO: 13888) |
| 88 | TTGGRMGR + A + YH + TGTTGACY | (SEQ ID NO: 13889) |
| 88 | TTGGRMGR + A + YHTGTTGAC | (SEQ ID NO: 13890) |
| 88 | T + TGGRMGRAYHTGTTGAC | (SEQ ID NO: 13891) |
| 88 | TTGG + RMGRAYHTGTTGAC | (SEQ ID NO: 13892) |
| 88 | TTG + GRMGRAYHTGTTGAC | (SEQ ID NO: 13893) |
| 88 | TT + GGRMGRAYHTGTTGAC | (SEQ ID NO: 13894) |
| 88 | TTGGRMGRAYHTGTTGA + C | (SEQ ID NO: 13895) |
| 88 | TTGGRMGRAYHTGTT + GAC | (SEQ ID NO: 13896) |
| 88 | TTGGRMGRAYHTG + TTGAC | (SEQ ID NO: 13897) |
| 88 | TTGGRMGRAYH + TGTTGAC | (SEQ ID NO: 13898) |
| 88 | TTGGRM + GR + A + YHTGTTGAC | (SEQ ID NO: 13899) |
| 88 | TT + GGRMGR + A + YHTGTTGAC | (SEQ ID NO: 13900) |
| 88 | TTGGRMG + R + A + YHTGTTGAC | (SEQ ID NO: 13901) |
| 88 | TTGGR + MGR + A + YHTGTTGAC | (SEQ ID NO: 13902) |
| 88 | TTGGRMGR + A + YHTGTTGA + C | (SEQ ID NO: 13903) |
| 88 | TTGGRMGR + A + Y + HTGTTGAC | (SEQ ID NO: 13904) |
| 88 | TTGGRMGR + A + YHTG + TTGAC | (SEQ ID NO: 13905) |
| 88 | TTGGRMGR + A + YH + TGTTGAC | (SEQ ID NO: 13906) |
| 88 | TGGRMGR + A + YHTGTTGAC | (SEQ ID NO: 13907) |
| 88 | +TGGRMGRAYHTGTTGAC | (SEQ ID NO: 13908) |
| 88 | TGG + RMGRAYHTGTTGAC | (SEQ ID NO: 13909) |
| 88 | TG + GRMGRAYHTGTTGAC | (SEQ ID NO: 13910) |
| 88 | T + GGRMGRAYHTGTTGAC | (SEQ ID NO: 13911) |
| 88 | TGGRMGRAYHTGTTGA + C | (SEQ ID NO: 13912) |
| 88 | TGGRMGRAYHTGTT + GAC | (SEQ ID NO: 13913) |
| 88 | TGGRMGRAYHTG + TTGAC | (SEQ ID NO: 13914) |
| 88 | TGGRMGRAYH + TGTTGAC | (SEQ ID NO: 13915) |

TABLE 10 -continued

| | |
|---|---|
| 88 | TGGRM + GR + A + YHTGTTGAC (SEQ ID NO: 13916) |
| 88 | T + GGRMGR + A + YHTGTTGAC (SEQ ID NO: 13917) |
| 88 | TGGRMG + R + A + YHTGTTGAC (SEQ ID NO: 13918) |
| 88 | TGGR + MGR + A + YHTGTTGAC (SEQ ID NO: 13919) |
| 88 | TGGRMGR + A + YHTGTTGA + C (SEQ ID NO: 13920) |
| 88 | TGGRMGR + A + Y + HTGTTGAC (SEQ ID NO: 13921) |
| 88 | TGGRMGR + A + YHTG + TTGAC (SEQ ID NO: 13922) |
| 88 | TGGRMGR + A + YH + TGTTGAC (SEQ ID NO: 13923) |
| 88 | TGGRMGR + A + YHTGTTG (SEQ ID NO: 13924) |
| 88 | +TGGRMGRAYHTGTTG (SEQ ID NO: 13925) |
| 88 | TGG + RMGRAYHTGTTG (SEQ ID NO: 13926) |
| 88 | TG + GRMGRAYHTGTTG (SEQ ID NO: 13927) |
| 88 | T + GGRMGRAYHTGTTG (SEQ ID NO: 13928) |
| 88 | TGGRMGRAYHTGTTGA (SEQ ID NO: 13929) |
| 88 | TGGRMGRAYHTGTT + G (SEQ ID NO: 13930) |
| 88 | TGGRMGRAYHTG + TTG (SEQ ID NO: 13931) |
| 88 | TGGRMGRAYH + TGTTG (SEQ ID NO: 13932) |
| 88 | TGGRM + GR + A + YHTGTTG (SEQ ID NO: 13933) |
| 88 | T + GGRMGR + A + YHTGTTG (SEQ ID NO: 13934) |
| 88 | TGGRMG + R + A + YHTGTTG (SEQ ID NO: 13935) |
| 88 | TGGR + MGR + A + YHTGTTG (SEQ ID NO: 13936) |
| 88 | TGGRMGR + A + YHTGTTGA (SEQ ID NO: 13937) |
| 88 | TGGRMGR + A + Y + HTGTTG (SEQ ID NO: 13938) |
| 88 | TGGRMGR + A + YHTG + TTG (SEQ ID NO: 13939) |
| 88 | TGGRMGR + A + YH + TGTTG (SEQ ID NO: 13940) |
| 88 | TGGAAGAGAYCTGTT (SEQ ID NO: 13941) |
| 88 | TGGAAGAAGYCTGTT (SEQ ID NO: 13942) |
| 88 | TGGAAGAACYCTGTT (SEQ ID NO: 13943) |
| 88 | TGGAAGAGGYCTGTT (SEQ ID NO: 13944) |
| 88 | TTGGRMGRAYHTGTTGACY (SEQ ID NO: 13945) |
| 88 | TTGGRMGRAYHTGTTGAC (SEQ ID NO: 13946) |
| 88 | TGGRMGRAYHTGTTGAC (SEQ ID NO: 13947) |
| 88 | TGGRMGRAYHTGTTG (SEQ ID NO: 13948) |
| 89 | GGRMGRAA + Y + TGTTGACYCA (SEQ ID NO: 13949) |
| 89 | G + GRMGRAAYTGTTGACYCA (SEQ ID NO: 13950) |
| 89 | GG + RMGRAAYTGTTGACYCA (SEQ ID NO: 13951) |
| 89 | GGRMGRAA + YTGTTGACYCA (SEQ ID NO: 13952) |
| 89 | GGR + MGRAAYTGTTGACYCA (SEQ ID NO: 13953) |
| 89 | GGRMGRAAYTGTTGACY + CA (SEQ ID NO: 13954) |
| 89 | GGRMGRAAYTGTT + GACYCA (SEQ ID NO: 13955) |

TABLE 10 -continued

| | |
|---|---|
| 89 | GGRMGRAAYTGT + TGACYCA (SEQ ID NO: 13956) |
| 89 | GGRMGRAAYTGTTG + ACYCA (SEQ ID NO: 13957) |
| 89 | GG + RMGRAA + Y + TGTTGACYCA (SEQ ID NO: 13958) |
| 89 | GGR + MGRAA + Y + TGTTGACYCA (SEQ ID NO: 13959) |
| 89 | GGRMGRA + A + Y + TGTTGACYCA (SEQ ID NO: 13960) |
| 89 | GGRMG + RAA + Y + TGTTGACYCA (SEQ ID NO: 13961) |
| 89 | GGRMGRAA + Y + TGTTG + ACYCA (SEQ ID NO: 13962) |
| 89 | GGRMGRAA + Y + T + GTTGACYCA (SEQ ID NO: 13963) |
| 89 | GGRMGRAA + Y + TGTT + GACYCA (SEQ ID NO: 13964) |
| 89 | GGRMGRAA + Y + TGTTGACY + CA (SEQ ID NO: 13965) |
| 89 | GGRMGRAA + Y + TGTTGACYC (SEQ ID NO: 13966) |
| 89 | G + GRMGRAAYTGTTGACYC (SEQ ID NO: 13967) |
| 89 | GG + RMGRAAYTGTTGACYC (SEQ ID NO: 13968) |
| 89 | GGRMGRAA + YTGTTGACYC (SEQ ID NO: 13969) |
| 89 | GGR + MGRAAYTGTTGACYC (SEQ ID NO: 13970) |
| 89 | GGRMGRAAYTGTTGACY + C (SEQ ID NO: 13971) |
| 89 | GGRMGRAAYTGTT + GACYC (SEQ ID NO: 13972) |
| 89 | GGRMGRAAYTGT + TGACYC (SEQ ID NO: 13973) |
| 89 | GGRMGRAAYTGTTG + ACYC (SEQ ID NO: 13974) |
| 89 | GG + RMGRAA + Y + TGTTGACYC (SEQ ID NO: 13975) |
| 89 | GGR + MGRAA + Y + TGTTGACYC (SEQ ID NO: 13976) |
| 89 | GGRMGRA + A + Y + TGTTGACYC (SEQ ID NO: 13977) |
| 89 | GGRMG + RAA + Y + TGTTGACYC (SEQ ID NO: 13978) |
| 89 | GGRMGRAA + Y + TGTTG + ACYC (SEQ ID NO: 13979) |
| 89 | GGRMGRAA + Y + T + GTTGACYC (SEQ ID NO: 13980) |
| 89 | GGRMGRAA + Y + TGTT + GACYC (SEQ ID NO: 13981) |
| 89 | GGRMGRAA + Y + TGTTGACY + C (SEQ ID NO: 13982) |
| 89 | GRMGRAA + Y + TGTTGACYC (SEQ ID NO: 13983) |
| 89 | +GRMGRAAYTGTTGACYC (SEQ ID NO: 13984) |
| 89 | G + RMGRAAYTGTTGACYC (SEQ ID NO: 13985) |
| 89 | GRMGRAA + YTGTTGACYC (SEQ ID NO: 13986) |
| 89 | GR + MGRAAYTGTTGACYC (SEQ ID NO: 13987) |
| 89 | GRMGRAAYTGTTGACY + C (SEQ ID NO: 13988) |
| 89 | GRMGRAAYTGTT + GACYC (SEQ ID NO: 13989) |
| 89 | GRMGRAAYTGT + TGACYC (SEQ ID NO: 13990) |
| 89 | GRMGRAAYTGTTG + ACYC (SEQ ID NO: 13991) |
| 89 | G + RMGRAA + Y + TGTTGACYC (SEQ ID NO: 13992) |
| 89 | GR + MGRAA + Y + TGTTGACYC (SEQ ID NO: 13993) |
| 89 | GRMGRA + A + Y + TGTTGACYC (SEQ ID NO: 13994) |
| 89 | GRMG + RAA + Y + TGTTGACYC (SEQ ID NO: 13995) |

TABLE 10 -continued

| | |
|---|---|
| 89 | GRMGRAA + Y + TGTTG + ACYC (SEQ ID NO: 13996) |
| 89 | GRMGRAA + Y + T + GTTGACYC (SEQ ID NO: 13997) |
| 89 | GRMGRAA + Y + TGTT + GACYC (SEQ ID NO: 13998) |
| 89 | GRMGRAA + Y + TGTTGACY + C (SEQ ID NO: 13999) |
| 89 | GRMGRAA + Y + TGTTGAC (SEQ ID NO: 14000) |
| 89 | +GRMGRAAYTGTTGAC (SEQ ID NO: 14001) |
| 89 | G + RMGRAAYTGTTGAC (SEQ ID NO: 14002) |
| 89 | GRMGRAA + YTGTTGAC (SEQ ID NO: 14003) |
| 89 | GR + MGRAAYTGTTGAC (SEQ ID NO: 14004) |
| 89 | GRMGRAAYTGTTGACY (SEQ ID NO: 14005) |
| 89 | GRMGRAAYTGTT + GAC (SEQ ID NO: 14006) |
| 89 | GRMGRAAYTGT + TGAC (SEQ ID NO: 14007) |
| 89 | GRMGRAAYTGTTG + AC (SEQ ID NO: 14008) |
| 89 | G + RMGRAA + Y + TGTTGAC (SEQ ID NO: 14009) |
| 89 | GR + MGRAA + Y + TGTTGAC (SEQ ID NO: 14010) |
| 89 | GRMGRA + A + Y + TGTTGAC (SEQ ID NO: 14011) |
| 89 | GRMG + RAA + Y + TGTTGAC (SEQ ID NO: 14012) |
| 89 | GRMGRAA + Y + TGTTG + AC (SEQ ID NO: 14013) |
| 89 | GRMGRAA + Y + T + GTTGAC (SEQ ID NO: 14014) |
| 89 | GRMGRAA + Y + TGTT + GAC (SEQ ID NO: 14015) |
| 89 | GRMGRAA + Y + TGTTGACY (SEQ ID NO: 14016) |
| 89 | AAGAAATGTRTTGAC (SEQ ID NO: 14017) |
| 89 | GGRMGRAAYTGTTGACYCA (SEQ ID NO: 14018) |
| 89 | GGRMGRAAYTGTTGACYC (SEQ ID NO: 14019) |
| 89 | GRMGRAAYTGTTGACYC (SEQ ID NO: 14020) |
| 89 | GRMGRAAYTGTTGAC (SEQ ID NO: 14021) |
| 90 | MGRAAYHT + G + TGACYCARMT (SEQ ID NO: 14022) |
| 90 | MGRAA + YHTGTGACYCARMT (SEQ ID NO: 14023) |
| 90 | MGRAAYH + TGTGACYCARMT (SEQ ID NO: 14024) |
| 90 | MGRA + AYHTGTGACYCARMT (SEQ ID NO: 14025) |
| 90 | MGR + AAYHTGTGACYCARMT (SEQ ID NO: 14026) |
| 90 | MGRAAYHTGTGACYC + ARMT (SEQ ID NO: 14027) |
| 90 | MGRAAYHTG + TGACYCARMT (SEQ ID NO: 14028) |
| 90 | MGRAAYHTGTGACY + CARMT (SEQ ID NO: 14029) |
| 90 | MGRAAYHTGTGAC + YCARMT (SEQ ID NO: 14030) |
| 90 | MGRA + AYHT + G + TGACYCARMT (SEQ ID NO: 14031) |
| 90 | M + GRAAYHT + G + TGACYCARMT (SEQ ID NO: 14032) |
| 90 | MG + RAAYHT + G + TGACYCARMT (SEQ ID NO: 14033) |
| 90 | MGRAA + YHT + G + TGACYCARMT (SEQ ID NO: 14034) |
| 90 | MGRAAYHT + G + TGACYCA + RMT (SEQ ID NO: 14035) |

TABLE 10 -continued

| | |
|---|---|
| 90 | MGRAAYHT + G + T + GACYCARMT (SEQ ID NO: 14036) |
| 90 | MGRAAYHT + G + TGAC + YCARMT (SEQ ID NO: 14037) |
| 90 | MGRAAYHT + G + TGACYC + ARMT (SEQ ID NO: 14038) |
| 90 | MGRAAYHT + G + TGACYCARM (SEQ ID NO: 14039) |
| 90 | MGRAA + YHTGTGACYCARM (SEQ ID NO: 14040) |
| 90 | MGRAAYH + TGTGACYCARM (SEQ ID NO: 14041) |
| 90 | MGRA + AYHTGTGACYCARM (SEQ ID NO: 14042) |
| 90 | MGR + AAYHTGTGACYCARM (SEQ ID NO: 14043) |
| 90 | MGRAAYHTGTGACYC + ARM (SEQ ID NO: 14044) |
| 90 | MGRAAYHTG + TGACYCARM (SEQ ID NO: 14045) |
| 90 | MGRAAYHTGTGACY + CARM (SEQ ID NO: 14046) |
| 90 | MGRAAYHTGTGAC + YCARM (SEQ ID NO: 14047) |
| 90 | MGRA + AYHT + G + TGACYCARM (SEQ ID NO: 14048) |
| 90 | M + GRAAYHT + G + TGACYCARM (SEQ ID NO: 14049) |
| 90 | MG + RAAYHT + G + TGACYCARM (SEQ ID NO: 14050) |
| 90 | MGRAA + YHT + G + TGACYCARM (SEQ ID NO: 14051) |
| 90 | MGRAAYHT + G + TGACYCA + RM (SEQ ID NO: 14052) |
| 90 | MGRAAYHT + G + T + GACYCARM (SEQ ID NO: 14053) |
| 90 | MGRAAYHT + G + TGAC + YCARM (SEQ ID NO: 14054) |
| 90 | MGRAAYHT + G + TGACYC + ARM (SEQ ID NO: 14055) |
| 90 | GRAAYHT + G + TGACYCARM (SEQ ID NO: 14056) |
| 90 | GRAA + YHTGTGACYCARM (SEQ ID NO: 14057) |
| 90 | GRAAYH + TGTGACYCARM (SEQ ID NO: 14058) |
| 90 | GRA + AYHTGTGACYCARM (SEQ ID NO: 14059) |
| 90 | GR + AAYHTGTGACYCARM (SEQ ID NO: 14060) |
| 90 | GRAAYHTGTGACYC + ARM (SEQ ID NO: 14061) |
| 90 | GRAAYHTG + TGACYCARM (SEQ ID NO: 14062) |
| 90 | GRAAYHTGTGACY + CARM (SEQ ID NO: 14063) |
| 90 | GRAAYHTGTGAC + YCARM (SEQ ID NO: 14064) |
| 90 | GRA + AYHT + G + TGACYCARM (SEQ ID NO: 14065) |
| 90 | +GRAAYHT + G + TGACYCARM (SEQ ID NO: 14066) |
| 90 | G + RAAYHT + G + TGACYCARM (SEQ ID NO: 14067) |
| 90 | GRAA + YHT + G + TGACYCARM (SEQ ID NO: 14068) |
| 90 | GRAAYHT + G + TGACYCA + RM (SEQ ID NO: 14069) |
| 90 | GRAAYHT + G + T + GACYCARM (SEQ ID NO: 14070) |
| 90 | GRAAYHT + G + TGAC + YCARM (SEQ ID NO: 14071) |
| 90 | GRAAYHT + G + TGACYC + ARM (SEQ ID NO: 14072) |
| 90 | GRAAYHT + G + TGACYCA (SEQ ID NO: 14073) |
| 90 | GRAA + YHTGTGACYCA (SEQ ID NO: 14074) |
| 90 | GRAAYH + TGTGACYCA (SEQ ID NO: 14075) |

TABLE 10 -continued

| 90 | GRA + AYHTGTGACYCA (SEQ ID NO: 14076) |
| 90 | GR + AAYHTGTGACYCA (SEQ ID NO: 14077) |
| 90 | GRAAYHTGTGACYC + A (SEQ ID NO: 14078) |
| 90 | GRAAYHTG + TGACYCA (SEQ ID NO: 14079) |
| 90 | GRAAYHTGTGACY + CA (SEQ ID NO: 14080) |
| 90 | GRAAYHTGTGAC + YCA (SEQ ID NO: 14081) |
| 90 | GRA + AYHT + G + TGACYCA (SEQ ID NO: 14082) |
| 90 | +GRAAYHT + G + TGACYCA (SEQ ID NO: 14083) |
| 90 | G + RAAYHT + G + TGACYCA (SEQ ID NO: 14084) |
| 90 | GRAA + YHT + G + TGACYCA (SEQ ID NO: 14085) |
| 90 | GRAAYHT + G + TGACYCA (SEQ ID NO: 14086) |
| 90 | GRAAYHT + G + T + GACYCA (SEQ ID NO: 14087) |
| 90 | GRAAYHT + G + TGAC + YCA (SEQ ID NO: 14088) |
| 90 | GRAAYHT + G + TGACYC + A (SEQ ID NO: 14089) |
| 90 | AAATCTGATGACTCA (SEQ ID NO: 14090) |
| 90 | MGRAAYHTGTGACYCARMT (SEQ ID NO: 14091) |
| 90 | MGRAAYHTGTGACYCARM (SEQ ID NO: 14092) |
| 90 | GRAAYHTGTGACYCARM (SEQ ID NO: 14093) |
| 90 | GRAAYHTGTGACYCA (SEQ ID NO: 14094) |

Table 11 depicts forward and reverse primers for the HIV-1 integrase gene. A "+" symbol preceding a nucleotide denotes that the nucleotide is an LNA.

TABLE 11

| Codon | Forward Primer (5' to 3') |
|---|---|
| 51 | ATAGTRGCYWRYTGTGAYAARTGYCARBTAAAAGGRGAAGCCATG (SEQ ID NO: 14095) |
| 51 | ATAGTRGCYWRYTGTGAYAARTGYCARBTAAAAGGRGAAGCCATG + N (SEQ ID NO: 14096) |
| 66 | A + C + ARG + TRGAYTGYAGYCCAGGRATATGGCARYTAGAYTGY (SEQ ID NO: 14097) |
| 66 | A + CARG + TRG + AYTGYAGYCCAGGRATATGGCARYTAGAYTGY (SEQ ID NO: 14098) |
| 66 | A + C + ARGTRG + AYTGYAGYCCAGGRATATGGCARYTAGAYTGY (SEQ ID NO:14099) |
| 66 | +ARG + TRG + AYTGYAGYCCAGGRATATGGCARYTAGAYTGY (SEQ ID NO: 14100) |
| 66 | +ARGTRG + AYT + GYAGYCCAGGRATATGGCARYTAGAYTGY (SEQ ID NO: 14101) |
| 66 | +ARG + TRGAYT + GYAGYCCAGGRATATGGCARYTAGAYTGY (SEQ ID NO: 14102) |
| 66 | +TRG + AYT + GYAGYCCAGGRATATGGCARYTAGAYTGY (SEQ ID NO: 14103) |
| 66 | +TRGAYT + GYAGY + CCAGGRATATGGCARYTAGAYTGY (SEQ ID NO: 14104) |
| 66 | +TRG + AYTGYAGY + CCAGGRATATGGCARYTAGAYTGY (SEQ ID NO: 14105) |
| 66 | +AYT + GYAGY + CCAGGRATATGGCARYTAGAYTGY (SEQ ID NO: 14106) |
| 66 | +AYTGYAGY + C + CAGGRATATGGCARYTAGAYTGY (SEQ ID NO: 14107) |
| 66 | +AYT + GYAGYC + CAGGRATATGGCARYTAGAYTGY (SEQ ID NO: 14108) |

TABLE 11-continued

| | |
|---|---|
| 66 | +GYAGY + C + CAGGRATATGGCARYTAGAYTGY (SEQ ID NO: 14109) |
| 66 | +GYAGYC + CA + GGRATATGGCARYTAGAYTGY (SEQ ID NO: 14110) |
| 66 | +GYAGY + CCA + GGRATATGGCARYTAGAYTGY (SEQ ID NO: 14111) |
| 66 | +C + CA + GGRATATGGCARYTAGAYTGY (SEQ ID NO: 14112) |
| 66 | +CCA + GGRATA + TGGCARYTAGAYTGY (SEQ ID NO: 14113) |
| 66 | +C + CAGGRATA + TGGCARYTAGAYTGY (SEQ ID NO: 14114) |
| 66 | +C + ARG + TRGAYTGYAGYCCAGGRATATGGCARYTAGAYTGYA (SEQ ID NO: 14115) |
| 66 | +CARG + TRG + AYTGYAGYCCAGGRATATGGCARYTAGAYTGYA (SEQ ID NO: 14116) |
| 66 | +C + ARGTRG + AYTGYAGYCCAGGRATATGGCARYTAGAYTGYA (SEQ ID NO: 14117) |
| 66 | +ARG + TRG + AYTGYAGYCCAGGRATATGGCARYTAGAYTGYA (SEQ ID NO: 14118) |
| 66 | +ARGTRG + AYT + GYAGYCCAGGRATATGGCARYTAGAYTGYA (SEQ ID NO: 14119) |
| 66 | +ARG + TRGAYT + GYAGYCCAGGRATATGGCARYTAGAYTGYA (SEQ ID NO: 14120) |
| 66 | +TRG + AYT + GYAGYCCAGGRATATGGCARYTAGAYTGYA (SEQ ID NO: 14121) |
| 66 | +TRGAYT + GYAGY + CCAGGRATATGGCARYTAGAYTGYA (SEQ ID NO: 14122) |
| 66 | +TRG + AYTGYAGY + CCAGGRATATGGCARYTAGAYTGYA (SEQ ID NO: 14123) |
| 66 | +AYT + GYAGY + CCAGGRATATGGCARYTAGAYTGYA (SEQ ID NO: 14124) |
| 66 | +AYTGYAGY + C + CAGGRATATGGCARYTAGAYTGYA (SEQ ID NO: 14125) |
| 66 | +AYT + GYAGYC + CAGGRATATGGCARYTAGAYTGYA (SEQ ID NO: 14126) |
| 66 | +GYAGY + C + CAGGRATATGGCARYTAGAYTGYA (SEQ ID NO: 14127) |
| 66 | +GYAGYC + CA + GGRATATGGCARYTAGAYTGYA (SEQ ID NO: 14128) |
| 66 | +GYAGY + CCA + GGRATATGGCARYTAGAYTGYA (SEQ ID NO: 14129) |
| 66 | +C + CA + GGRATATGGCARYTAGAYTGYA (SEQ ID NO: 14130) |
| 66 | +CCA + GGRATA + TGGCARYTAGAYTGYA (SEQ ID NO: 14131) |
| 66 | +C + CAGGRATA + TGGCARYTAGAYTGYA (SEQ ID NO: 14132) |
| 66 | ACARGTRGAYTGYAGYCCAGGRATATGGCARYTAGAYTGY (SEQ ID NO: 14133) |
| 66 | ARGTRGAYTGYAGYCCAGGRATATGGCARYTAGAYTGY (SEQ ID NO: 14134) |
| 66 | TRGAYTGYAGYCCAGGRATATGGCARYTAGAYTGY (SEQ ID NO: 14135) |
| 66 | AYTGYAGYCCAGGRATATGGCARYTAGAYTGY (SEQ ID NO: 14136) |
| 66 | GYAGYCCAGGRATATGGCARYTAGAYTGY (SEQ ID NO: 14137) |
| 66 | CCAGGRATATGGCARYTAGAYTGY (SEQ ID NO: 14138) |
| 66 | CARGTRGAYTGYAGYCCAGGRATATGGCARYTAGAYTGYA (SEQ ID NO: 14139) |
| 66 | ARGTRGAYTGYAGYCCAGGRATATGGCARYTAGAYTGYA (SEQ ID NO: 14140) |
| 66 | TRGAYTGYAGYCCAGGRATATGGCARYTAGAYTGYA (SEQ ID NO: 14141) |
| 66 | AYTGYAGYCCAGGRATATGGCARYTAGAYTGYA (SEQ ID NO: 14142) |
| 66 | GYAGYCCAGGRATATGGCARYTAGAYTGYA (SEQ ID NO: 14143) |
| 66 | CCAGGRATATGGCARYTAGAYTGYA (SEQ ID NO:14144) |
| 66 | CATGGACARGTRGAYTGYAGYCCAGGRATATGGCARYTAGATTGT (SEQ ID NO: 14145) |
| 66 | ACARGTRGAYTGYAGYCCAGGRATATGGCARYTAGAYTGY + N (SEQ ID NO: 14146) |

TABLE 11-continued

| | |
|---|---|
| 66 | ARGTRGAYTGYAGYCCAGGRATATGGCARYTAGAYTGY + N (SEQ ID NO: 14147) |
| 66 | TRGAYTGYAGYCCAGGRATATGGCARYTAGAYTGY + N (SEQ ID NO: 14148) |
| 66 | AYTGYAGYCCAGGRATATGGCARYTAGAYTGY + N (SEQ ID NO: 14149) |
| 66 | GYAGYCCAGGRATATGGCARYTAGAYTGY + N (SEQ ID NO: 14150) |
| 66 | CCAGGRATATGGCARYTAGAYTGY + N (SEQ ID NO: 14151) |
| 66 | CARGTRGAYTGYAGYCCAGGRATATGGCARYTAGAYTGYA + N (SEQ ID NO: 14152) |
| 66 | ARGTRGAYTGYAGYCCAGGRATATGGCARYTAGAYTGYA + N (SEQ ID NO: 14153) |
| 66 | TRGAYTGYAGYCCAGGRATATGGCARYTAGAYTGYA + N (SEQ ID NO: 14154) |
| 66 | AYTGYAGYCCAGGRATATGGCARYTAGAYTGYA + N (SEQ ID NO: 14155) |
| 66 | GYAGYCCAGGRATATGGCARYTAGAYTGYA + N (SEQ ID NO: 14156) |
| 66 | CCAGGRATATGGCARYTAGAYTGYA + N (SEQ ID NO: 14157) |
| 66 | CATGGACARGTRGAYTGYAGYCCAGGRATATGGCARYTAGATTGT + N (SEQ ID NO: 14158) |
| 74 | A + T + G + GCARYTAGAYTGYACACAYYTAGAAGGRAAARTHATY (SEQ ID NO: 14159) |
| 74 | A + TG + G + CARYTAGAYTGYACACAYYTAGAAGGRAAARTHATY (SEQ ID NO: 14160) |
| 74 | A + T + GG + CARYTAGAYTGYACACAYYTAGAAGGRAAARTHATY (SEQ ID NO: 14161) |
| 74 | +G + G + CARYTAGAYTGYACACAYYTAGAAGGRAAARTHATY (SEQ ID NO: 14162) |
| 74 | +GG + C + ARYTAGAYTGYACACAYYTAGAAGGRAAARTHATY (SEQ ID NO: 14163) |
| 74 | +G + GC + ARYTAGAYTGYACACAYYTAGAAGGRAAARTHATY (SEQ ID NO: 14164) |
| 74 | +G + C + ARYTAGAYTGYACACAYYTAGAAGGRAAARTHATY (SEQ ID NO: 14165) |
| 74 | +GC + ARY + TAGAYTGYACACAYYTAGAAGGRAAARTHATY (SEQ ID NO: 14166) |
| 74 | +G + CARY + TAGAYTGYACACAYYTAGAAGGRAAARTHATY (SEQ ID NO: 14167) |
| 74 | +C + ARY + TAGAYTGYACACAYYTAGAAGGRAAARTHATY (SEQ ID NO: 14168) |
| 74 | +CARY + TA + GAYTGYACACAYYTAGAAGGRAAARTHATY (SEQ ID NO: 14169) |
| 74 | +C + ARYTA + GAYTGYACACAYYTAGAAGGRAAARTHATY (SEQ ID NO: 14170) |
| 74 | +ARY + TA + GAYTGYACACAYYTAGAAGGRAAARTHATY (SEQ ID NO: 14171) |
| 74 | +ARYTA + G + AYTGYACACAYYTAGAAGGRAAARTHATY (SEQ ID NO: 14172) |
| 74 | +ARY + TAG + AYTGYACACAYYTAGAAGGRAAARTHATY (SEQ ID NO: 14173) |
| 74 | +TA + G + AYTGYACACAYYTAGAAGGRAAARTHATY (SEQ ID NO: 14174) |
| 74 | +TAG + AY + TGYACACAYYTAGAAGGRAAARTHATY (SEQ ID NO: 14175) |
| 74 | +TA + GAY + TGYACACAYYTAGAAGGRAAARTHATY (SEQ ID NO: 14176) |
| 74 | ATGGCARYTAGAYTGYACACAYYTAGAAGGRAAARTHATY (SEQ ID NO: 14177) |
| 74 | GGCARYTAGAYTGYACACAYYTAGAAGGRAAARTHATY (SEQ ID NO: 14178) |
| 74 | GCARYTAGAYTGYACACAYYTAGAAGGRAAARTHATY (SEQ ID NO: 14179) |
| 74 | CARYTAGAYTGYACACAYYTAGAAGGRAAARTHATY (SEQ ID NO: 14180) |
| 74 | ARYTAGAYTGYACACAYYTAGAAGGRAAARTHATY (SEQ ID NO: 14181) |
| 74 | TAGAYTGYACACAYYTAGAAGGRAAARTHATY (SEQ ID NO: 14182) |
| 74 | GGRATATGGCARYTAGAYTGYACACAYYTAGAAGGRAAAATTATC (SEQ ID NO: 14183) |
| 74 | ATGGCARYTAGAYTGYACACAYYTAGAAGGRAAARTHATY + N (SEQ ID NO: 14184) |
| 74 | GGCARYTAGAYTGYACACAYYTAGAAGGRAAARTHATY + N (SEQ ID NO: 14185) |

TABLE 11-continued

| | |
|---|---|
| 74 | GCARYTAGAYTGYACACAYYTAGAAGGRAAARTHATY + N (SEQ ID NO: 14186) |
| 74 | CARYTAGAYTGYACACAYYTAGAAGGRAAARTHATY + N (SEQ ID NO: 14187) |
| 74 | ARYTAGAYTGYACACAYYTAGAAGGRAAARTHATY + N (SEQ ID NO: 14188) |
| 74 | TAGAYTGYACACAYYTAGAAGGRAAARTHATY + N (SEQ ID NO: 14189) |
| 74 | GGRATATGGCARYTAGAYTGYACACAYYTAGAAGGRAAAATTATC + N (SEQ ID NO: 14190) |
| 92 | +G + TR + GCYAGTGGMTAYATRGAAGCAGARGTYATYCCAGCAG (SEQ ID NO: 14191) |
| 92 | +GTR + G + CYAGTGGMTAYATRGAAGCAGARGTYATYCCAGCAG (SEQ ID NO: 14192) |
| 92 | +G + TRG + CYAGTGGMTAYATRGAAGCAGARGTYATYCCAGCAG (SEQ ID NO: 14193) |
| 92 | +TR + G + CYAGTGGMTAYATRGAAGCAGARGTYATYCCAGCAG (SEQ ID NO: 14194) |
| 92 | +TRG + CY + AGTGGMTAYATRGAAGCAGARGTYATYCCAGCAG (SEQ ID NO: 14195) |
| 92 | +TR + GCY + AGTGGMTAYATRGAAGCAGARGTYATYCCAGCAG (SEQ IDNO:14196) |
| 92 | +G + CY + AGTGGMTAYATRGAAGCAGARGTYATYCCAGCAG (SEQ IDNO:14197) |
| 92 | +GCY + A + GTGGMTAYATRGAAGCAGARGTYATYCCAGCAG (SEQ IDNO:14198) |
| 92 | +G + CYA + GTGGMTAYATRGAAGCAGARGTYATYCCAGCAG (SEQ IDNO:14199) |
| 92 | +CY + A + GTGGMTAYATRGAAGCAGARGTYATYCCAGCAG (SEQ IDNO:14200) |
| 92 | +CYA + GT + GGMTAYATRGAAGCAGARGTYATYCCAGCAG (SEQ ID NO: 14201) |
| 92 | +CY + AGT + GGMTAYATRGAAGCAGARGTYATYCCAGCAG (SEQ ID NO: 14202) |
| 92 | +A + GT + GGMTAYATRGAAGCAGARGTYATYCCAGCAG (SEQ ID NO: 14203) |
| 92 | +AGT + G + GMTAYATRGAAGCAGARGTYATYCCAGCAG (SEQ ID NO: 14204) |
| 92 | +A + GTG + GMTAYATRGAAGCAGARGTYATYCCAGCAG (SEQ ID NO: 14205) |
| 92 | +GT + G + GMTAYATRGAAGCAGARGTYATYCCAGCAG (SEQ ID NO: 14206) |
| 92 | +GTG + GM + TAYATRGAAGCAGARGTYATYCCAGCAG (SEQ ID NO: 14207) |
| 92 | +GT + GGM + TAYATRGAAGCAGARGTYATYCCAGCAG (SEQ ID NO: 14208) |
| 92 | Y + G + TR + GCYAGTGGMTAYATRGAAGCAGARGTYATYCCAGCA (SEQ ID NO: 14209) |
| 92 | Y + GTR + G + CYAGTGGMTAYATRGAAGCAGARGTYATYCCAGCA (SEQ ID NO: 14210) |
| 92 | Y + G + TRG + CYAGTGGMTAYATRGAAGCAGARGTYATYCCAGCA (SEQ ID NO: 14211) |
| 92 | +TR + G + CYAGTGGMTAYATRGAAGCAGARGTYATYCCAGCA (SEQ ID NO: 14212) |
| 92 | +TRG + CY + AGTGGMTAYATRGAAGCAGARGTYATYCCAGCA (SEQ ID NO: 14213) |
| 92 | +TR + GCY + AGTGGMTAYATRGAAGCAGARGTYATYCCAGCA (SEQ ID NO: 14214) |
| 92 | +G + CY + AGTGGMTAYATRGAAGCAGARGTYATYCCAGCA (SEQ ID NO: 14215) |
| 92 | +GCY + A + GTGGMTAYATRGAAGCAGARGTYATYCCAGCA (SEQ ID NO: 14216) |
| 92 | +G + CYA + GTGGMTAYATRGAAGCAGARGTYATYCCAGCA (SEQ ID NO: 14217) |
| 92 | +CY + A + GTGGMTAYATRGAAGCAGARGTYATYCCAGCA (SEQ ID NO: 14218) |
| 92 | +CYA + GT + GGMTAYATRGAAGCAGARGTYATYCCAGCA (SEQ ID NO: 14219) |
| 92 | +CY + AGT + GGMTAYATRGAAGCAGARGTYATYCCAGCA (SEQ ID NO: 14220) |
| 92 | +A + GT + GGMTAYATRGAAGCAGARGTYATYCCAGCA (SEQ ID NO: 14221) |
| 92 | +AGT + G + GMTAYATRGAAGCAGARGTYATYCCAGCA (SEQ ID NO: 14222) |
| 92 | +A + GTG + GMTAYATRGAAGCAGARGTYATYCCAGCA (SEQ ID NO: 14223) |

TABLE 11-continued

| | |
|---|---|
| 92 | +GT + G + GMTAYATRGAAGCAGARGTYATYCCAGCA (SEQ ID NO: 14224) |
| 92 | +GTG + GM + TAYATRGAAGCAGARGTYATYCCAGCA (SEQ ID NO: 14225) |
| 92 | +GT + GGM + TAYATRGAAGCAGARGTYATYCCAGCA (SEQ ID NO: 14226) |
| 92 | GTRGCYAGTGGMTAYATRGAAGCAGARGTYATYCCAGCAG (SEQ ID NO: 14227) |
| 92 | TRGCYAGTGGMTAYATRGAAGCAGARGTYATYCCAGCAG (SEQ ID NO: 14228) |
| 92 | GCYAGTGGMTAYATRGAAGCAGARGTYATYCCAGCAG (SEQ ID NO: 14229) |
| 92 | CYAGTGGMTAYATRGAAGCAGARGTYATYCCAGCAG (SEQ ID NO: 14230) |
| 92 | AGTGGMTAYATRGAAGCAGARGTYATYCCAGCAG (SEQ ID NO: 14231) |
| 92 | GTGGMTAYATRGAAGCAGARGTYATYCCAGCAG (SEQ ID NO: 14232) |
| 92 | YGTRGCYAGTGGMTAYATRGAAGCAGARGTYATYCCAGCA (SEQ ID NO: 14233) |
| 92 | TRGCYAGTGGMTAYATRGAAGCAGARGTYATYCCAGCA (SEQ ID NO: 14234) |
| 92 | GCYAGTGGMTAYATRGAAGCAGARGTYATYCCAGCA (SEQ ID NO: 14235) |
| 92 | CYAGTGGMTAYATRGAAGCAGARGTYATYCCAGCA (SEQ ID NO: 14236) |
| 92 | AGTGGMTAYATRGAAGCAGARGTYATYCCAGCA (SEQ ID NO: 14237) |
| 92 | GTGGMTAYATRGAAGCAGARGTYATYCCAGCA (SEQ ID NO: 14238) |
| 92 | GTYCAYGTRGCYAGTGGVTAYATRGAAGCAGARGTYATCCCAGCA (SEQ ID NO: 14239) |
| 92 | GTRGCYAGTGGMTAYATRGAAGCAGARGTYATYCCAGCAG + N (SEQ ID NO: 14240) |
| 92 | TRGCYAGTGGMTAYATRGAAGCAGARGTYATYCCAGCAG + N (SEQ ID NO: 14241) |
| 92 | GCYAGTGGMTAYATRGAAGCAGARGTYATYCCAGCAG + N (SEQ ID NO: 14242) |
| 92 | CYAGTGGMTAYATRGAAGCAGARGTYATYCCAGCAG + N (SEQ ID NO: 14243) |
| 92 | AGTGGMTAYATRGAAGCAGARGTYATYCCAGCAG + N (SEQ ID NO: 14244) |
| 92 | GTGGMTAYATRGAAGCAGARGTYATYCCAGCAG + N (SEQ ID NO: 14245) |
| 92 | YGTRGCYAGTGGMTAYATRGAAGCAGARGTYATYCCAGCA + N (SEQ ID NO: 14246) |
| 92 | TRGCYAGTGGMTAYATRGAAGCAGARGTYATYCCAGCA + N (SEQ ID NO: 14247) |
| 92 | GCYAGTGGMTAYATRGAAGCAGARGTYATYCCAGCA + N (SEQ ID NO: 14248) |
| 92 | CYAGTGGMTAYATRGAAGCAGARGTYATYCCAGCA + N (SEQ ID NO: 14249) |
| 92 | AGTGGMTAYATRGAAGCAGARGTYATYCCAGCA + N (SEQ ID NO: 14250) |
| 92 | GTGGMTAYATRGAAGCAGARGTYATYCCAGCA + N (SEQ ID NO: 14251) |
| 92 | GTYCAYGTRGCYAGTGGVTAYATRGAAGCAGARGTYATCCCAGCA + N (SEQ ID NO: 14252) |
| 97 | YA + TR + G + AAGCAGARGTYATYCCAGCAGARACAGGRCARGAR (SEQ ID NO: 14253) |
| 97 | YA + TRG + AA + GCAGARGTYATYCCAGCAGARACAGGRCARGAR (SEQ ID NO: 14254) |
| 97 | YA + TR + GAA + GCAGARGTYATYCCAGCAGARACAGGRCARGAR (SEQ ID NO: 14255) |
| 97 | +G + AA + GCAGARGTYATYCCAGCAGARACAGGRCARGAR (SEQ ID NO: 14256) |
| 97 | +GAA + G + CAGARGTYATYCCAGCAGARACAGGRCARGAR (SEQ ID NO: 14257) |
| 97 | +G + AAG + CAGARGTYATYCCAGCAGARACAGGRCARGAR (SEQ ID NO: 14258) |

TABLE 11-continued

| | |
|---|---|
| 97 | +AA + G + CAGARGTYATYCCAGCAGARACAGGRCARGAR (SEQ ID NO: 14259) |
| 97 | +AAG + CAG + ARGTYATYCCAGCAGARACAGGRCARGAR (SEQ ID NO: 14260) |
| 97 | +AA + GCAG + ARGTYATYCCAGCAGARACAGGRCARGAR (SEQ ID NO: 14261) |
| 97 | +G + CAG + ARGTYATYCCAGCAGARACAGGRCARGAR (SEQ ID NO: 14262) |
| 97 | +GCAG + ARG + TYATYCCAGCAGARACAGGRCARGAR (SEQ ID NO: 14263) |
| 97 | +G + CAGARG + TYATYCCAGCAGARACAGGRCARGAR (SEQ ID NO: 14264) |
| 97 | +CAG + ARG + TYATYCCAGCAGARACAGGRCARGAR (SEQ ID NO: 14265) |
| 97 | +CAGARG + TYA + TYCCAGCAGARACAGGRCARGAR (SEQ ID NO: 14266) |
| 97 | +CAG + ARGTYA + TYCCAGCAGARACAGGRCARGAR (SEQ ID NO: 14267) |
| 97 | +ARG + TYA + TYCCAGCAGARACAGGRCARGAR (SEQ ID NO: 14268) |
| 97 | +ARGTYA + TYCCAGCAGARACAGGRCARGAR (SEQ ID NO: 14269) |
| 97 | +ARG + TYATYCCAGCAGARACAGGRCARGAR (SEQ ID NO: 14270) |
| 97 | YATRGAAGCAGARGTYATYCCAGCAGARACAGGRCARGAR (SEQ ID NO: 14271) |
| 97 | GAAGCAGARGTYATYCCAGCAGARACAGGRCARGAR (SEQ ID NO: 14272) |
| 97 | AAGCAGARGTYATYCCAGCAGARACAGGRCARGAR (SEQ ID NO: 14273) |
| 97 | GCAGARGTYATYCCAGCAGARACAGGRCARGAR (SEQ ID NO: 14274) |
| 97 | CAGARGTYATYCCAGCAGARACAGGRCARGAR (SEQ ID NO: 14275) |
| 97 | ARGTYATYCCAGCAGARACAGGRCARGAR (SEQ ID NO: 14276) |
| 97 | TGGVTAYATRGAAGCAGARGTYATYCCAGCAGARACAGGACAGGAA (SEQ ID NO: 14277) |
| 97 | YATRGAAGCAGARGTYATYCCAGCAGARACAGGRCARGAR + N (SEQ ID NO: 14278) |
| 97 | GAAGCAGARGTYATYCCAGCAGARACAGGRCARGAR + N (SEQ ID NO: 14279) |
| 97 | AAGCAGARGTYATYCCAGCAGARACAGGRCARGAR + N (SEQ ID NO: 14280) |
| 97 | GCAGARGTYATYCCAGCAGARACAGGRCARGAR + N (SEQ ID NO: 14281) |
| 97 | CAGARGTYATYCCAGCAGARACAGGRCARGAR + N (SEQ ID NO: 14282) |
| 97 | ARGTYATYCCAGCAGARACAGGRCARGAR + N (SEQ ID NO: 14283) |
| 97 | TGGVTAYATRGAAGCAGARGTYATYCCAGCAGARACAGGACAGGAA + N (SEQ ID NO: 14284) |
| 118 | AG + CA + GGAAGR + TGGCCAGTVAARRYARTACAYACAGAYAAT (SEQ ID NO: 14285) |
| 118 | AG + CAGGAAGR + T + GGCCAGTVAARRYARTACAYACAGAYAAT (SEQ ID NO: 14286) |
| 118 | AG + CA + GGAAGRT + GGCCAGTVAARRYARTACAYACAGAYAAT (SEQ ID NO: 14287) |
| 118 | +GGAAGR + T + GGCCAGTVAARRYARTACAYACAGAYAAT (SEQ ID NO: 14288) |
| 118 | +GGAAGRT + G + GCCAGTVAARRYARTACAYACAGAYAAT (SEQ ID NO: 14289) |
| 118 | +GGAAGR + TG + GCCAGTVAARRYARTACAYACAGAYAAT (SEQ ID NO: 14290) |
| 118 | +T + G + GCCAGTVAARRYARTACAYACAGAYAAT (SEQ ID NO: 14291) |
| 118 | +TG + G + CCAGTVAARRYARTACAYACAGAYAAT (SEQ ID NO: 14292) |
| 118 | +T + GG + CCAGTVAARRYARTACAYACAGAYAAT (SEQ ID NO: 14293) |
| 118 | +G + G + CCAGTVAARRYARTACAYACAGAYAAT (SEQ ID NO: 14294) |
| 118 | +GG + C + CAGTVAARRYARTACAYACAGAYAAT (SEQ ID NO: 14295) |
| 118 | +G + GC + CAGTVAARRYARTACAYACAGAYAAT (SEQ ID NO: 14296) |
| 118 | +G + C + CAGTVAARRYARTACAYACAGAYAAT (SEQ ID NO: 14297) |

TABLE 11-continued

| | | |
|---|---|---|
| 118 | +GC + CAG + TVAARRYARTACAYACAGAYAAT | (SEQ ID NO: 14298) |
| 118 | +G + CCAG + TVAARRYARTACAYACAGAYAAT | (SEQ ID NO: 14299) |
| 118 | +C + CAG + TVAARRYARTACAYACAGAYAAT | (SEQ ID NO: 14300) |
| 118 | +CCAG + TVAARRYAR + TACAYACAGAYAAT | (SEQ ID NO: 14301) |
| 118 | +C + CAGTVAARRYAR + TACAYACAGAYAAT | (SEQ ID NO: 14302) |
| 118 | AGCAGGAAGRTGGCCAGTVAARRYARTACAYACAGAYAAT | (SEQ ID NO: 14303) |
| 118 | GGAAGRTGGCCAGTVAARRYARTACAYACAGAYAAT | (SEQ ID NO: 14304) |
| 118 | TGGCCAGTVAARRYARTACAYACAGAYAAT | (SEQ ID NO: 14305) |
| 118 | GGCCAGTVAARRYARTACAYACAGAYAAT | (SEQ ID NO: 14306) |
| 118 | GCCAGTVAARRYARTACAYACAGAYAAT | (SEQ ID NO: 14307) |
| 118 | CCAGTVAARRYARTACAYACAGAYAAT | (SEQ ID NO: 14308) |
| 118 | AAARYTAGCAGGRAGRTGGCCAGTVARARYARTACAYACAGACAAT | (SEQ ID NO: 14309) |
| 118 | AGCAGGAAGRTGGCCAGTVAARRYARTACAYACAGAYAAT + N | (SEQ ID NO: 14310) |
| 118 | GGAAGRTGGCCAGTVAARRYARTACAYACAGAYAAT + N | (SEQ ID NO: 14311) |
| 118 | TGGCCAGTVAARRYARTACAYACAGAYAAT + N | (SEQ ID NO: 14312) |
| 118 | GGCCAGTVAARRYARTACAYACAGAYAAT + N | (SEQ ID NO: 14313) |
| 118 | GCCAGTVAARRYARTACAYACAGAYAAT + N | (SEQ ID NO: 14314) |
| 118 | CCAGTVAARRYARTACAYACAGAYAAT + N | (SEQ ID NO: 14315) |
| 118 | AAARYTAGCAGGRAGRTGGCCAGTVARARYARTACAYACAGACAAT + N | (SEQ ID NO: 14316) |
| 121 | +T + G + GCCAGTVAARRYARTACAYACAGAYAATGGYMSYAAYT | (SEQ ID NO: 14317) |
| 121 | +TG + G + CCAGTVAARRYARTACAYACAGAYAATGGYMSYAAYT | (SEQ ID NO: 14318) |
| 121 | +T + GG + CCAGTVAARRYARTACAYACAGAYAATGGYMSYAAYT | (SEQ ID NO: 14319) |
| 121 | +G + G + CCAGTVAARRYARTACAYACAGAYAATGGYMSYAAYT | (SEQ ID NO: 14320) |
| 121 | +GG + C + CAGTVAARRYARTACAYACAGAYAATGGYMSYAAYT | (SEQ ID NO: 14321) |
| 121 | +G + GC + CAGTVAARRYARTACAYACAGAYAATGGYMSYAAYT | (SEQ ID NO: 14322) |
| 121 | +G + C + CAGTVAARRYARTACAYACAGAYAATGGYMSYAAYT | (SEQ ID NO: 14323) |
| 121 | +GC + CAG + TVAARRYARTACAYACAGAYAATGGYMSYAAYT | (SEQ ID NO: 14324) |
| 121 | +G + CCAG + TVAARRYARTACAYACAGAYAATGGYMSYAAYT | (SEQ ID NO: 14325) |
| 121 | +C + CAG + TVAARRYARTACAYACAGAYAATGGYMSYAAYT | (SEQ ID NO: 14326) |
| 121 | +CCAG + TVAARRYAR + TACAYACAGAYAATGGYMSYAAYT | (SEQ ID NO: 14327) |
| 121 | +C + CAGTVAARRYAR + TACAYACAGAYAATGGYMSYAAYT | (SEQ ID NO: 14328) |
| 121 | +CAG + TVAARRYAR + TACAYACAGAYAATGGYMSYAAYT | (SEQ ID NO: 14329) |
| 121 | +CAGTVAARRYAR + TA + CAYACAGAYAATGGYMSYAAYT | (SEQ ID NO: 14330) |
| 121 | +CAG + TVAARRYARTA + CAYACAGAYAATGGYMSYAAYT | (SEQ ID NO: 14331) |
| 121 | +TVAARRYAR + TA + CAYACAGAYAATGGYM SYAAYT | (SEQ ID NO: 14332) |
| 121 | +TVAARRYARTA + C + AYACAGAYAATGGYM SYAAYT | (SEQ ID NO: 14333) |

TABLE 11-continued

| | |
|---|---|
| 121 | +TVAARRYAR + TAC + AYACAGAYAATGGYM SYAAYT (SEQ ID NO: 14334) |
| 121 | TGGCCAGTVAARRYARTACAYACAGAYAATGGYMSYAAYT (SEQ ID NO: 14335) |
| 121 | GGCCAGTVAARRYARTACAYACAGAYAATGGYMSYAAYT (SEQ ID NO: 14336) |
| 121 | GCCAGTVAARRYARTACAYACAGAYAATGGYMSYAAYT (SEQ ID NO: 14337) |
| 121 | CCAGTVAARRYARTACAYACAGAYAATGGYMSYAAYT (SEQ ID NO: 14338) |
| 121 | CAGTVAARRYARTACAYACAGAYAATGGYM SYAAYT (SEQ ID NO: 14339) |
| 121 | TVAARRYARTACAYACAGAYAATGGYMSYAAYT (SEQ ID NO: 14340) |
| 121 | GGRAGRTGGCCAGTVARARYARTACAYACAGAYAAYGGYAGCAAT (SEQ ID NO: 14341) |
| 121 | TGGCCAGTVAARRYARTACAYACAGAYAATGGYMSYAAYT + N (SEQ ID NO: 14342) |
| 121 | GGCCAGTVAARRYARTACAYACAGAYAATGGYMSYAAYT + N (SEQ ID NO: 14343) |
| 121 | GCCAGTVAARRYARTACAYACAGAYAATGGYMSYAAYT + N (SEQ ID NO: 14344) |
| 121 | CCAGTVAARRYARTACAYACAGAYAATGGYMSYAAYT + N (SEQ ID NO: 14345) |
| 121 | CAGTVAARRYARTACAYACAGAYAATGGYMSYAAYT + N (SEQ ID NO: 14346) |
| 121 | TVAARRYARTACAYACAGAYAATGGYMSYAAYT + N (SEQ ID NO: 14347) |
| 121 | GGRAGRTGGCCAGTVARARYARTACAYACAGAYAAYGGYAGCAAT + N (SEQ ID NO: 14348) |
| 138 | RCRGTHAAR + G + CH + GCMTGYTGGTGGGCVRRBRTCMMRCARG (SEQ ID NO: 14349) |
| 138 | RCRGTHAAR + GCH + G + CMTGYTGGTGGGCVRRBRTCMMRCARG (SEQ ID NO: 14350) |
| 138 | RCRGTHAAR + G + CHG + CMTGYTGGTGGGCVRRBRTCMMRCARG (SEQ ID NO: 14351) |
| 138 | +CH + G + CMTGYTGGTGGGCVRRBRTCMMRCARG (SEQ ID NO: 14352) |
| 138 | +CHG + CM + TGYTGGTGGGCVRRBRTCMMRCARG (SEQ ID NO: 14353) |
| 138 | +CH + GCM + TGYTGGTGGGCVRRBRTCMMRCARG (SEQ ID NO: 14354) |
| 138 | +G + CM + TGYTGGTGGGCVRRBRTCMMRCARG (SEQ ID NO: 14355) |
| 138 | +GCM + T + GYTGGTGGGCVRRBRTCMMRCARG (SEQ ID NO: 14356) |
| 138 | +G + CMT + GYTGGTGGGCVRRBRTCMMRCARG (SEQ ID NO: 14357) |
| 138 | +CM + T + GYTGGTGGGCVRRBRTCMMRCARG (SEQ ID NO: 14358) |
| 138 | +CMT + GY + TGGTGGGCVRRBRTCMMRCARG (SEQ ID NO: 14359) |
| 138 | +CM + TGY + TGGTGGGCVRRBRTCMMRCARG (SEQ ID NO: 14360) |
| 138 | +T + GY + TGGTGGGCVRRBRTCMMRCARG (SEQ ID NO: 14361) |
| 138 | +TGY + T + GGTGGGCVRRBRTCMMRCARG (SEQ ID NO: 14362) |
| 138 | +T + GYT + GGTGGGCVRRBRTCMMRCARG (SEQ ID NO: 14363) |
| 138 | +GY + T + GGTGGGCVRRBRTCMMRCARG (SEQ ID NO: 14364) |
| 138 | +GYT + G + GTGGGCVRRBRTCMMRCARG (SEQ ID NO: 14365) |
| 138 | +GY + TG + GTGGGCVRRBRTCMMRCARG (SEQ ID NO: 14366) |
| 138 | TRCRGTHAAR + G + CH + GCMTGYTGGTGGGCVRRBRTCMMRCAR (SEQ ID NO: 14367) |
| 138 | TRCRGTHAAR + GCH + G + CMTGYTGGTGGGCVRRBRTCMMRCAR (SEQ ID NO: 14368) |

TABLE 11-continued

| | | |
|---|---|---|
| 138 | TRCRGTHAAR + G + CHG + CMTGYTGGTGGGCVRRBRTCMMRCAR (SEQ ID NO: 14369) | |
| 138 | +CH + G + CMTGYTGGTGGGCVRRBRTCMMRCAR (SEQ ID NO: 14370) | |
| 138 | +CHG + CM + TGYTGGTGGGCVRRBRTCMMRCAR (SEQ ID NO: 14371) | |
| 138 | +CH + GCM + TGYTGGTGGGCVRRBRTCMMRCAR (SEQ ID NO: 14372) | |
| 138 | +G + CM + TGYTGGTGGGCVRRBRTCMMRCAR (SEQ ID NO: 14373) | |
| 138 | +GCM + T + GYTGGTGGGCVRRBRTCMMRCAR (SEQ ID NO: 14374) | |
| 138 | +G + CMT + GYTGGTGGGCVRRBRTCMMRCAR (SEQ ID NO: 14375) | |
| 138 | +CM + T + GYTGGTGGGCVRRBRTCMMRCAR (SEQ ID NO: 14376) | |
| 138 | +CMT + GY + TGGTGGGCVRRBRTCMMRCAR (SEQ ID NO: 14377) | |
| 138 | +CM + TGY + TGGTGGGCVRRBRTCMMRCAR (SEQ ID NO: 14378) | |
| 138 | +T + GY + TGGTGGGCVRRBRTCMMRCAR (SEQ ID NO: 14379) | |
| 138 | +TGY + T + GGTGGGCVRRBRTCMMRCAR (SEQ ID NO: 14380) | |
| 138 | +T + GYT + GGTGGGCVRRBRTCMMRCAR (SEQ ID NO: 14381) | |
| 138 | +GY + T + GGTGGGCVRRBRTCMMRCAR (SEQ ID NO: 14382) | |
| 138 | +GYT + G + GTGGGCVRRBRTCMMRCAR (SEQ ID NO: 14383) | |
| 138 | +GY + TG + GTGGGCVRRBRTCMMRCAR (SEQ ID NO: 14384) | |
| 138 | RCRGTHAARGCHGCMTGYTGGTGGGCVRRBRTCMMRCARG (SEQ ID NO: 14385) | |
| 138 | CHGCMTGYTGGTGGGCVRRBRTCMMRCARG (SEQ ID NO: 14386) | |
| 138 | GCMTGYTGGTGGGCVRRBRTCMMRCARG (SEQ ID NO: 14387) | |
| 138 | CMTGYTGGTGGGCVRRBRTCMMRCARG (SEQ ID NO: 14388) | |
| 138 | TGYTGGTGGGCVRRBRTCMMRCARG (SEQ ID NO: 14389) | |
| 138 | GYTGGTGGGCVRRBRTCMMRCARG (SEQ ID NO: 14390) | |
| 138 | TRCRGTHAARGCHGCMTGYTGGTGGGCVRRBRTCMMRCAR (SEQ ID NO: 14391) | |
| 138 | CHGCMTGYTGGTGGGCVRRBRTCMMRCAR (SEQ ID NO: 14392) | |
| 138 | GCMTGYTGGTGGGCVRRBRTCMMRCAR (SEQ ID NO: 14393) | |
| 138 | CMTGYTGGTGGGCVRRBRTCMMRCAR (SEQ ID NO: 14394) | |
| 138 | TGYTGGTGGGCVRRBRTCMMRCAR (SEQ ID NO: 14395) | |
| 138 | GYTGGTGGGCVRRBRTCMMRCAR (SEQ ID NO: 14396) | |
| 138 | AGYRMYRCRGTHAARGCHGCMTGYTGGTGGGCVRRDRTYAAACAG (SEQ ID NO: 14397) | |
| 138 | RCRGTHAARGCHGCMTGYTGGTGGGCVRRBRTCMMRCARG + N (SEQ ID NO: 14398) | |
| 138 | CHGCMTGYTGGTGGGCVRRBRTCMMRCARG + N (SEQ ID NO: 14399) | |
| 138 | GCMTGYTGGTGGGCVRRBRTCMMRCARG + N (SEQ ID NO: 14400) | |
| 138 | CMTGYTGGTGGGCVRRBRTCMMRCARG + N (SEQ ID NO: 14401) | |
| 138 | TGYTGGTGGGCVRRBRTCMMRCARG + N (SEQ ID NO: 14402) | |
| 138 | GYTGGTGGGCVRRBRTCMMRCARG + N (SEQ ID NO: 14403) | |
| 138 | TRCRGTHAARGCHGCMTGYTGGTGGGCVRRBRTCMMRCAR + N (SEQ ID NO: 14404) | |
| 138 | CHGCMTGYTGGTGGGCVRRBRTCMMRCAR + N (SEQ ID NO: 14405) | |
| 138 | GCMTGYTGGTGGGCVRRBRTCMMRCAR + N (SEQ ID NO: 14406) | |
| 138 | CMTGYTGGTGGGCVRRBRTCMMRCAR + N (SEQ ID NO: 14407) | |

TABLE 11-continued

| | |
|---|---|
| 138 | TGYTGGTGGGCVRRBRTCMMRCAR + N (SEQ ID NO: 14408) |
| 138 | GYTGGTGGGCVRRBRTCMMRCAR + N (SEQ ID NO: 14409) |
| 138 | AGYRMYRCRGTHAARGCHGCMTGYTGGTGGGCVRRDRTYAAACAG + N (SEQ ID NO: 14410) |
| 140 | AAR + G + CH + GCMTGYTGGTGGGCVRRBRTCMMRCARGAATTTG (SEQ ID NO: 14411) |
| 140 | AAR + GCH + G + CMTGYTGGTGGGCVRRBRTCMMRCARGAATTTG (SEQ ID NO: 14412) |
| 140 | AAR + G + CHG + CMTGYTGGTGGGCVRRBRTCMMRCARGAATTTG (SEQ ID NO: 14413) |
| 140 | +CH + G + CMTGYTGGTGGGCVRRBRTCMMRCARGAATTTG (SEQ ID NO: 14414) |
| 140 | +CHG + CM + TGYTGGTGGGCVRRBRTCMMRCARGAATTTG (SEQ ID NO: 14415) |
| 140 | +CH + GCM + TGYTGGTGGGCVRRBRTCMMRCARGAATTTG (SEQ ID NO: 14416) |
| 140 | +G + CM + TGYTGGTGGGCVRRBRTCMMRCARGAATTTG (SEQ ID NO: 14417) |
| 140 | +GCM + T + GYTGGTGGGCVRRBRTCMMRCARGAATTTG (SEQ ID NO: 14418) |
| 140 | +G + CMT + GYTGGTGGGCVRRBRTCMMRCARGAATTTG (SEQ ID NO: 14419) |
| 140 | +CM + T + GYTGGTGGGCVRRBRTCMMRCARGAATTTG (SEQ ID NO: 14420) |
| 140 | +CMT + GY + TGGTGGGCVRRBRTCMMRCARGAATTTG (SEQ ID NO: 14421) |
| 140 | +CM + TGY + TGGTGGGCVRRBRTCMMRCARGAATTTG (SEQ ID NO: 14422) |
| 140 | +T + GY + TGGTGGGCVRRBRTCMMRCARGAATTTG (SEQ ID NO: 14423) |
| 140 | +TGY + T + GGTGGGCVRRBRTCMMRCARGAATTTG (SEQ ID NO: 14424) |
| 140 | +T + GYT + GGTGGGCVRRBRTCMMRCARGAATTTG (SEQ ID NO: 14425) |
| 140 | +GY + T + GGTGGGCVRRBRTCMMRCARGAATTTG (SEQ ID NO: 14426) |
| 140 | +GYT + G + GTGGGCVRRBRTCMMRCARGAATTTG (SEQ ID NO: 14427) |
| 140 | +GY + TG + GTGGGCVRRBRTCMMRCARGAATTTG (SEQ ID NO: 14428) |
| 140 | HAAR + G + CH + GCMTGYTGGTGGGCVRRBRTCMMRCARGAATTT (SEQ ID NO: 14429) |
| 140 | HAAR + GCH + G + CMTGYTGGTGGGCVRRBRTCMMRCARGAATTT (SEQ ID NO: 14430) |
| 140 | HAAR + G + CHG + CMTGYTGGTGGGCVRRBRTCMMRCARGAATTT (SEQ ID NO: 14431) |
| 140 | +CH + G + CMTGYTGGTGGGCVRRBRTCMMRCARGAATTT (SEQ ID NO: 14432) |
| 140 | +CHG + CM + TGYTGGTGGGCVRRBRTCMMRCARGAATTT (SEQ ID NO: 14433) |
| 140 | +CH + GCM + TGYTGGTGGGCVRRBRTCMMRCARGAATTT (SEQ ID NO: 14434) |
| 140 | +G + CM + TGYTGGTGGGCVRRBRTCMMRCARGAATTT (SEQ ID NO: 14435) |
| 140 | +GCM + T + GYTGGTGGGCVRRBRTCMMRCARGAATTT (SEQ ID NO: 14436) |
| 140 | +G + CMT + GYTGGTGGGCVRRBRTCMMRCARGAATTT (SEQ ID NO: 14437) |
| 140 | +CM + T + GYTGGTGGGCVRRBRTCMMRCARGAATTT (SEQ ID NO: 14438) |
| 140 | +CMT + GY + TGGTGGGCVRRBRTCMMRCARGAATTT (SEQ ID NO: 14439) |
| 140 | +CM + TGY + TGGTGGGCVRRBRTCMMRCARGAATTT (SEQ ID NO: 14440) |
| 140 | +T + GY + TGGTGGGCVRRBRTCMMRCARGAATTT (SEQ ID NO: 14441) |
| 140 | +TGY + T + GGTGGGCVRRBRTCMMRCARGAATTT (SEQ ID NO: 14442) |
| 140 | +T + GYT + GGTGGGCVRRBRTCMMRCARGAATTT (SEQ ID NO: 14443) |
| 140 | +GY + T + GGTGGGCVRRBRTCMMRCARGAATTT (SEQ ID NO: 14444) |
| 140 | +GYT + G + GTGGGCVRRBRTCMMRCARGAATTT (SEQ ID NO: 14445) |
| 140 | +GY + TG + GTGGGCVRRBRTCMMRCARGAATTT (SEQ ID NO: 14446) |

TABLE 11-continued

| 140 | AARGCHGCMTGYTGGTGGGCVRRBRTCMMRCARGAATTTG (SEQ ID NO: 14447) |
| 140 | CHGCMTGYTGGTGGGCVRRBRTCMMRCARGAATTTG (SEQ ID NO: 14448) |
| 140 | GCMTGYTGGTGGGCVRRBRTCMMRCARGAATTTG (SEQ ID NO: 14449) |
| 140 | CMTGYTGGTGGGCVRRBRTCMMRCARGAATTTG (SEQ ID NO: 14450) |
| 140 | TGYTGGTGGGCVRRBRTCMMRCARGAATTTG (SEQ ID NO: 14451) |
| 140 | GYTGGTGGGCVRRBRTCMMRCARGAATTTG (SEQ ID NO: 14452) |
| 140 | HAARGCHGCMTGYTGGTGGGCVRRBRTCMMRCARGAATTT (SEQ ID NO: 14453) |
| 140 | CHGCMTGYTGGTGGGCVRRBRTCMMRCARGAATTT (SEQ ID NO: 14454) |
| 140 | GCMTGYTGGTGGGCVRRBRTCMMRCARGAATTT (SEQ ID NO: 14455) |
| 140 | CMTGYTGGTGGGCVRRBRTCMMRCARGAATTT (SEQ ID NO: 14456) |
| 140 | TGYTGGTGGGCVRRBRTCMMRCARGAATTT (SEQ ID NO: 14457) |
| 140 | GYTGGTGGGCVRRBRTCMMRCARGAATTT (SEQ ID NO: 14458) |
| 140 | RCRGTHAARGCHGCMTGYTGGTGGGCVRRDRTYMVRCARGAATTT (SEQ ID NO: 14459) |
| 140 | AARGCHGCMTGYTGGTGGGCVRRBRTCMMRCARGAATTTG + N (SEQ ID NO: 14460) |
| 140 | CHGCMTGYTGGTGGGCVRRBRTCMMRCARGAATTTG + N (SEQ ID NO: 14461) |
| 140 | GCMTGYTGGTGGGCVRRBRTCMMRCARGAATTTG + N (SEQ ID NO: 14462) |
| 140 | CMTGYTGGTGGGCVRRBRTCMMRCARGAATTTG + N (SEQ ID NO:14463) |
| 140 | TGYTGGTGGGCVRRBRTCMMRCARGAATTTG + N (SEQ ID NO: 14464) |
| 140 | GYTGGTGGGCVRRBRTCMMRCARGAATTTG + N (SEQ ID NO: 14465) |
| 140 | HAARGCHGCMTGYTGGTGGGCVRRBRTCMMRCARGAATTT + N (SEQ ID NO: 14466) |
| 140 | CHGCMTGYTGGTGGGCVRRBRTCMMRCARGAATTT + N (SEQ ID NO: 14467) |
| 140 | GCMTGYTGGTGGGCVRRBRTCMMRCARGAATTT + N (SEQ ID NO: 14468) |
| 140 | CMTGYTGGTGGGCVRRBRTCMMRCARGAATTT + N (SEQ ID NO: 14469) |
| 140 | TGYTGGTGGGCVRRBRTCMMRCARGAATTT + N (SEQ ID NO: 14470) |
| 140 | GYTGGTGGGCVRRBRTCMMRCARGAATTT + N (SEQ ID NO: 14471) |
| 140 | RCRGTHAARGCHGCMTGYTGGTGGGCVRRDRTYMVRCARGAATTT + N (SEQ ID NO: 14472) |
| 143 | +T + GY + TGGTGGGCVRRBRTCMMRCARGAATTTGGVATYCCCT (SEQ ID NO: 14473) |
| 143 | +TGY + T + GGTGGGCVRRBRTCMMRCARGAATTTGGVATYCCCT (SEQ ID NO: 14474) |
| 143 | +T + GYT + GGTGGGCVRRBRTCMMRCARGAATTTGGVATYCCCT (SEQ ID NO: 14475) |
| 143 | +GY + T + GGTGGGCVRRBRTCMMRCARGAATTTGGVATYCCCT (SEQ ID NO: 14476) |
| 143 | +GYT + G + GTGGGCVRRBRTCMMRCARGAATTTGGVATYCCCT (SEQ ID NO: 14477) |
| 143 | +GY + TG + GTGGGCVRRBRTCMMRCARGAATTTGGVATYCCCT (SEQ ID NO: 14478) |
| 143 | +T + G + GTGGGCVRRBRTCMMRCARGAATTTGGVATYCCCT (SEQ ID NO: 14479) |
| 143 | +TG + GTG + GGCVRRBRTCMMRCARGAATTTGGVATYCCCT (SEQ ID NO: 14480) |
| 143 | +T + GGTG + GGCVRRBRTCMMRCARGAATTTGGVATYCCCT (SEQ ID NO: 14481) |
| 143 | +G + GTG + GGCVRRBRTCMMRCARGAATTTGGVATYCCCT (SEQ ID NO: 14482) |
| 143 | +GGTG + G + GCVRRBRTCMMRCARGAATTTGGVATYCCCT (SEQ ID NO: 14483) |
| 143 | +G + GTGG + GCVRRBRTCMMRCARGAATTTGGVATYCCCT (SEQ ID NO: 14484) |
| 143 | +GTG + G + GCVRRBRTCMMRCARGAATTTGGVATYCCCT (SEQ ID NO: 14485) |

TABLE 11-continued

| | |
|---|---|
| 143 | +GTGG + G + CVRRBRTCMMRCARGAATTTGGVATYCCCT (SEQ ID NO: 14486) |
| 143 | +GTG + GG + CVRRBRTCMMRCARGAATTTGGVATYCCCT (SEQ ID NO: 14487) |
| 143 | +G + G + CVRRBRTCMMRCARGAATTTGGVATYCCCT (SEQ ID NO: 14488) |
| 143 | +GG + CVRRBR + TCMMRCARGAATTTGGVATYCCCT (SEQ ID NO: 14489) |
| 143 | +G + GCVRRBR + TCMMRCARGAATTTGGVATYCCCT (SEQ ID NO: 14490) |
| 143 | M + T + GY + TGGTGGGCVRRBRTCMMRCARGAATTTGGVATYCCC (SEQ ID NO: 14491) |
| 143 | M + TGY + T + GGTGGGCVRRBRTCMMRCARGAATTTGGVATYCCC (SEQ ID NO: 14492) |
| 143 | M + T + GYT + GGTGGGCVRRBRTCMMRCARGAATTTGGVATYCCC (SEQ ID NO: 14493) |
| 143 | +GY + T + GGTGGGCVRRBRTCMMRCARGAATTTGGVATYCCC (SEQ ID NO: 14494) |
| 143 | +GYT + G + GTGGGCVRRBRTCMMRCARGAATTTGGVATYCCC (SEQ ID NO: 14495) |
| 143 | +GY + TG + GTGGGCVRRBRTCMMRCARGAATTTGGVATYCCC (SEQ ID NO: 14496) |
| 143 | +T + G + GTGGGCVRRBRTCMMRCARGAATTTGGVATYCCC (SEQ ID NO: 14497) |
| 143 | +TG + GTG + GGCVRRBRTCMMRCARGAATTTGGVATYCCC (SEQ ID NO: 14498) |
| 143 | +T + GGTG + GGCVRRBRTCMMRCARGAATTTGGVATYCCC (SEQ ID NO: 14499) |
| 143 | +G + GTG + GGCVRRBRTCMMRCARGAATTTGGVATYCCC (SEQ ID NO: 14500) |
| 143 | +GGTG + G + GCVRRBRTCMMRCARGAATTTGGVATYCCC (SEQ ID NO: 14501) |
| 143 | +G + GTGG + GCVRRBRTCMMRCARGAATTTGGVATYCCC (SEQ ID NO: 14502) |
| 143 | +GTG + G + GCVRRBRTCMMRCARGAATTTGGVATYCCC (SEQ ID NO: 14503) |
| 143 | +GTGG + G + CVRRBRTCMMRCARGAATTTGGVATYCCC (SEQ ID NO: 14504) |
| 143 | +GTG + GG + CVRRBRTCMMRCARGAATTTGGVATYCCC (SEQ ID NO: 14505) |
| 143 | +G + G + CVRRBRTCMMRCARGAATTTGGVATYCCC (SEQ ID NO: 14506) |
| 143 | +GG + CVRRBR + TCMMRCARGAATTTGGVATYCCC (SEQ ID NO: 14507) |
| 143 | +G + GCVRRBR + TCMMRCARGAATTTGGVATYCCC (SEQ ID NO: 14508) |
| 143 | TGYTGGTGGGCVRRBRTCMMRCARGAATTTGGVATYCCCT (SEQ ID NO: 14509) |
| 143 | GYTGGTGGGCVRRBRTCMMRCARGAATTTGGVATYCCCT (SEQ ID NO: 14510) |
| 143 | TGGTGGGCVRRBRTCMMRCARGAATTTGGVATYCCCT (SEQ ID NO: 14511) |
| 143 | GGTGGGCVRRBRTCMMRCARGAATTTGGVATYCCCT (SEQ ID NO: 14512) |
| 143 | GTGGGCVRRBRTCMMRCARGAATTTGGVATYCCCT (SEQ ID NO: 14513) |
| 143 | GGCVRRBRTCMMRCARGAATTTGGVATYCCCT (SEQ ID NO: 14514) |
| 143 | MTGYTGGTGGGCVRRBRTCMMRCARGAATTTGGVATYCCC (SEQ ID NO: 14515) |
| 143 | GYTGGTGGGCVRRBRTCMMRCARGAATTTGGVATYCCC (SEQ ID NO: 14516) |
| 143 | TGGTGGGCVRRBRTCMMRCARGAATTTGGVATYCCC (SEQ ID NO: 14517) |
| 143 | GGTGGGCVRRBRTCMMRCARGAATTTGGVATYCCC (SEQ ID NO: 14518) |
| 143 | GTGGGCVRRBRTCMMRCARGAATTTGGVATYCCC (SEQ ID NO: 14519) |
| 143 | GGCVRRBRTCMMRCARGAATTTGGVATYCCC (SEQ ID NO: 14520) |
| 143 | GCHGCMTGYTGGTGGGCVRRDRTYMVRCARGARTTTGGVATTCCC (SEQ ID NO: 14521) |
| 143 | TGYTGGTGGGCVRRBRTCMMRCARGAATTTGGVATYCCCT + N (SEQ ID NO: 14522) |
| 143 | GYTGGTGGGCVRRBRTCMMRCARGAATTTGGVATYCCCT + N (SEQ ID NO: 14523) |
| 143 | TGGTGGGCVRRBRTCMMRCARGAATTTGGVATYCCCT + N (SEQ ID NO: 14524) |

TABLE 11-continued

| | |
|---|---|
| 143 | GGTGGGCVRRBRTCMMRCARGAATTTGGVATYCCCT + N (SEQ ID NO: 14525) |
| 143 | GTGGGCVRRBRTCMMRCARGAATTTGGVATYCCCT + N (SEQ ID NO: 14526) |
| 143 | GGCVRRBRTCMMRCARGAATTTGGVATYCCCT + N (SEQ ID NO: 14527) |
| 143 | MTGYTGGTGGGCVRRBRTCMMRCARGAATTTGGVATYCCC + N (SEQ ID NO: 14528) |
| 143 | GYTGGTGGGCVRRBRTCMMRCARGAATTTGGVATYCCC + N (SEQ ID NO: 14529) |
| 143 | TGGTGGGCVRRBRTCMMRCARGAATTTGGVATYCCC + N (SEQ ID NO: 14530) |
| 143 | GGTGGGCVRRBRTCMMRCARGAATTTGGVATYCCC + N (SEQ ID NO: 14531) |
| 143 | GTGGGCVRRBRTCMMRCARGAATTTGGVATYCCC + N (SEQ ID NO: 14532) |
| 143 | GGCVRRBRTCMMRCARGAATTTGGVATYCCC + N (SEQ ID NO: 14533) |
| 143 | GCHGCMTGYTGGTGGGCVRRDRTYMVRCARGARTTTGGVATTCCC + N (SEQ ID NO: 14534) |
| 145 | +GTG + G + GCVRRBRTCMMRCARGAATTTGGVATYCCCTACAAT (SEQ ID NO: 14535) |
| 145 | +GTGG + G + CVRRBRTCMMRCARGAATTTGGVATYCCCTACAAT (SEQ ID NO: 14536) |
| 145 | +GTG + GG + CVRRBRTCMMRCARGAATTTGGVATYCCCTACAAT (SEQ ID NO: 14537) |
| 145 | +G + G + CVRRBRTCMMRCARGAATTTGGVATYCCCTACAAT (SEQ ID NO: 14538) |
| 145 | +GG + CVRRBR + TCMMRCARGAATTTGGVATYCCCTACAAT (SEQ ID NO: 14539) |
| 145 | +G + GCVRRBR + TCMMRCARGAATTTGGVATYCCCTACAAT (SEQ ID NO: 14540) |
| 145 | +G + CVRRBR + TCMMRCARGAATTTGGVATYCCCTACAAT (SEQ ID NO: 14541) |
| 145 | +GCVRRBR + TCMMR + CARGAATTTGGVATYCCCTACAAT (SEQ ID NO: 14542) |
| 145 | +G + CVRRBRTCMMR + CARGAATTTGGVATYCCCTACAAT (SEQ ID NO: 14543) |
| 145 | +CVRRBR + TCMMR + CARGAATTTGGVATYCCCTACAAT (SEQ ID NO: 14544) |
| 145 | +CVRRBRTCMMR + C + ARGAATTTGGVATYCCCTACAAT (SEQ ID NO: 14545) |
| 145 | +CVRRBR + TCMMRC + ARGAATTTGGVATYCCCTACAAT (SEQ ID NO: 14546) |
| 145 | +TCMMR + C + ARGAATTTGGVATYCCCTACAAT (SEQ ID NO: 14547) |
| 145 | +TCMMRC + AR + GAATTTGGVATYCCCTACAAT (SEQ ID NO: 14548) |
| 145 | +TCMMR + CAR + GAATTTGGVATYCCCTACAAT (SEQ ID NO: 14549) |
| 145 | +C + AR + GAATTTGGVATYCCCTACAAT (SEQ ID NO: 14550) |
| 145 | +CAR + GAA + TTTGGVATYCCCTACAAT (SEQ ID NO: 14551) |
| 145 | +C + ARGAA + TTTGGVATYCCCTACAAT (SEQ ID NO: 14552) |
| 145 | GTGGGCVRRBRTCMMRCARGAATTTGGVATYCCCTACAAT (SEQ ID NO: 14553) |
| 145 | GGCVRRBRTCMMRCARGAATTTGGVATYCCCTACAAT (SEQ ID NO: 14554) |
| 145 | GCVRRBRTCMMRCARGAATTTGGVATYCCCTACAAT (SEQ ID NO: 14555) |
| 145 | CVRRBRTCMMRCARGAATTTGGVATYCCCTACAAT (SEQ ID NO: 14556) |
| 145 | TCMMRCARGAATTTGGVATYCCCTACAAT (SEQ ID NO: 14557) |
| 145 | CARGAATTTGGVATYCCCTACAAT (SEQ ID NO: 14558) |
| 145 | TGYTGGTGGGCVRRDRTYMVRCARGARTTTGGVATYCCCTACAAT (SEQ ID NO: 14559) |
| 145 | GTGGGCVRRBRTCMMRCARGAATTTGGVATYCCCTACAAT + N (SEQ ID NO: 14560) |

TABLE 11-continued

| | |
|---|---|
| 145 | GGCVRRBRTCMMRCARGAATTTGGVATYCCCTACAAT + N (SEQ ID NO: 14561) |
| 145 | GCVRRBRTCMMRCARGAATTTGGVATYCCCTACAAT + N (SEQ ID NO: 14562) |
| 145 | CVRRBRTCMMRCARGAATTTGGVATYCCCTACAAT + N (SEQ ID NO: 14563) |
| 145 | TCMMRCARGAATTTGGVATYCCCTACAAT + N (SEQ ID NO: 14564) |
| 145 | CARGAATTTGGVATYCCCTACAAT + N (SEQ ID NO: 14565) |
| 145 | TGYTGGTGGGCVRRDRTYMVRCARGARTTTGGVATYCCCTACAAT + N (SEQ ID NO: 14566) |
| 146 | +G + CVRRBR + TCMMRCARGAATTTGGVATYCCCTACAATCCCC (SEQ ID NO: 14567) |
| 146 | +GCVRRBR + TCMMR + CARGAATTTGGVATYCCCTACAATCCCC (SEQ ID NO: 14568) |
| 146 | +G + CVRRBRTCMMR + CARGAATTTGGVATYCCCTACAATCCCC (SEQ ID NO: 14569) |
| 146 | +CVRRBR + TCMMR + CARGAATTTGGVATYCCCTACAATCCCC (SEQ ID NO: 14570) |
| 146 | +CVRRBRTCMMR + C + ARGAATTTGGVATYCCCTACAATCCCC (SEQ ID NO: 14571) |
| 146 | +CVRRBR + TCMMRC + ARGAATTTGGVATYCCCTACAATCCCC (SEQ ID NO: 14572) |
| 146 | +TCMMR + C + ARGAATTTGGVATYCCCTACAATCCCC (SEQ ID NO: 14573) |
| 146 | +TCMMRC + AR + GAATTTGGVATYCCCTACAATCCCC (SEQ ID NO: 14574) |
| 146 | +TCMMR + CAR + GAATTTGGVATYCCCTACAATCCCC (SEQ ID NO: 14575) |
| 146 | +C + AR + GAATTTGGVATYCCCTACAATCCCC (SEQ ID NO: 14576) |
| 146 | +CAR + GAA + TTTGGVATYCCCTACAATCCCC (SEQ ID NO: 14577) |
| 146 | +C + ARGAA + TTTGGVATYCCCTACAATCCCC (SEQ ID NO: 14578) |
| 146 | +AR + GAA + TTTGGVATYCCCTACAATCCCC (SEQ ID NO: 14579) |
| 146 | +ARGAA + TTTG + GVATYCCCTACAATCCCC (SEQ ID NO: 14580) |
| 146 | +AR + GAATTTG + GVATYCCCTACAATCCCC (SEQ ID NO: 14581) |
| 146 | +GAA + TTTG + GVATYCCCTACAATCCCC (SEQ ID NO: 14582) |
| 146 | +GAATTTG + GVA + TYCCCTACAATCCCC (SEQ ID NO: 14583) |
| 146 | +GAA + TTTGGVA + TYCCCTACAATCCCC (SEQ ID NO: 14584) |
| 146 | GCVRRBRTCMMRCARGAATTTGGVATYCCCTACAATCCCC (SEQ ID NO: 14585) |
| 146 | CVRRBRTCMMRCARGAATTTGGVATYCCCTACAATCCCC (SEQ ID NO: 14586) |
| 146 | TCMMRCARGAATTTGGVATYCCCTACAATCCCC (SEQ ID NO: 14587) |
| 146 | CARGAATTTGGVATYCCCTACAATCCCC (SEQ ID NO: 14588) |
| 146 | ARGAATTTGGVATYCCCTACAATCCCC (SEQ ID NO: 14589) |
| 146 | GAATTTGGVATYCCCTACAATCCCC (SEQ ID NO: 14590) |
| 146 | TGGTGGGCVRRDRTYMVRCARGARTTTGGVATYCCCTACAATCCC (SEQ ID NO: 14591) |
| 146 | GCVRRBRTCMMRCARGAATTTGGVATYCCCTACAATCCCC + N (SEQ ID NO: 14592) |
| 146 | CVRRBRTCMMRCARGAATTTGGVATYCCCTACAATCCCC + N (SEQ ID NO: 14593) |
| 146 | TCMMRCARGAATTTGGVATYCCCTACAATCCCC + N (SEQ ID NO: 14594) |
| 146 | CARGAATTTGGVATYCCCTACAATCCCC + N (SEQ ID NO: 14595) |
| 146 | ARGAATTTGGVATYCCCTACAATCCCC + N (SEQ ID NO: 14596) |
| 146 | GAATTTGGVATYCCCTACAATCCCC + N (SEQ ID NO: 14597) |

| | | |
|---|---|---|
| 146 | TGGTGGGCVRRDRTYMVRCARGARTTTGGVATYCCCTACAATCCC + N | (SEQ ID NO: 14598) |
| 147 | VRRBR + TCMMR + C + ARGAATTTGGVATYCCCTACAATCCCCAA | (SEQ ID NO: 14599) |
| 147 | VRRBR + TCMMRC + AR + GAATTTGGVATYCCCTACAATCCCCAA | (SEQ ID NO: 14600) |
| 147 | VRRBR + TCMMR + CAR + GAATTTGGVATYCCCTACAATCCCCAA | (SEQ ID NO: 14601) |
| 147 | +C + AR + GAATTTGGVATYCCCTACAATCCCCAA | (SEQ ID NO: 14602) |
| 147 | +CAR + GAA + TTTGGVATYCCCTACAATCCCCAA | (SEQ ID NO: 14603) |
| 147 | +C + ARGAA + TTTGGVATYCCCTACAATCCCCAA | (SEQ ID NO: 14604) |
| 147 | +AR + GAA + TTTGGVATYCCCTACAATCCCCAA | (SEQ ID NO: 14605) |
| 147 | +ARGAA + TTTG + GVATYCCCTACAATCCCCAA | (SEQ ID NO: 14606) |
| 147 | +AR + GAATTTG + GVATYCCCTACAATCCCCAA | (SEQ ID NO: 14607) |
| 147 | +GAA + TTTG + GVATYCCCTACAATCCCCAA | (SEQ ID NO: 14608) |
| 147 | +GAATTTG + GVA + TYCCCTACAATCCCCAA | (SEQ ID NO: 14609) |
| 147 | +GAA + TTTGGVA + TYCCCTACAATCCCCAA | (SEQ ID NO: 14610) |
| 147 | +TTTG + GVA + TYCCCTACAATCCCCAA | (SEQ ID NO: 14611) |
| 147 | +TTTGGVA + TY + CCCTACAATCCCCAA | (SEQ ID NO: 14612) |
| 147 | +TTTG + GVATY + CCCTACAATCCCCAA | (SEQ ID NO: 14613) |
| 147 | VRRBRTCMMRCARGAATTTGGVATYCCCTACAATCCCCAA | (SEQ ID NO: 14614) |
| 147 | CARGAATTTGGVATYCCCTACAATCCCCAA | (SEQ ID NO: 14615) |
| 147 | ARGAATTTGGVATYCCCTACAATCCCCAA | (SEQ ID NO: 14616) |
| 147 | GAATTTGGVATYCCCTACAATCCCCAA | (SEQ ID NO: 14617) |
| 147 | TTTGGVATYCCCTACAATCCCCAA | (SEQ ID NO: 14618) |
| 147 | TGGGCVRRDRTYMVRCARGARTTTGGVATYCCCTACAATCCCCAA | (SEQ ID NO: 14619) |
| 147 | VRRBRTCMMRCARGAATTTGGVATYCCCTACAATCCCCAA + N | (SEQ ID NO: 14620) |
| 147 | CARGAATTTGGVATYCCCTACAATCCCCAA + N | (SEQ ID NO: 14621) |
| 147 | ARGAATTTGGVATYCCCTACAATCCCCAA + N | (SEQ ID NO: 14622) |
| 147 | GAATTTGGVATYCCCTACAATCCCCAA + N | (SEQ ID NO: 14623) |
| 147 | TTTGGVATYCCCTACAATCCCCAA + N | (SEQ ID NO: 14624) |
| 147 | TGGGCVRRDRTYMVRCARGARTTTGGVATYCCCTACAATCCCCAA + N | (SEQ ID NO: 14625) |
| 148 | +TCMMR + C + ARGAATTTGGVATYCCCTACAATCCCCAAAGYCA | (SEQ ID NO: 14626) |
| 148 | +TCMMRC + AR + GAATTTGGVATYCCCTACAATCCCCAAAGYCA | (SEQ ID NO: 14627) |
| 148 | +TCMMR + CAR + GAATTTGGVATYCCCTACAATCCCCAAAGYCA | (SEQ ID NO: 14628) |
| 148 | +C + AR + GAATTTGGVATYCCCTACAATCCCCAAAGYCA | (SEQ ID NO: 14629) |
| 148 | +CAR + GAA + TTTGGVATYCCCTACAATCCCCAAAGYCA | (SEQ ID NO: 14630) |
| 148 | +C + ARGAA + TTTGGVATYCCCTACAATCCCCAAAGYCA | (SEQ ID NO: 14631) |
| 148 | +AR + GAA + TTTGGVATYCCCTACAATCCCCAAAGYCA | (SEQ ID NO: 14632) |
| 148 | +ARGAA + TTTG + GVATYCCCTACAATCCCCAAAGYCA | (SEQ ID NO: 14633) |
| 148 | +AR + GAATTTG + GVATYCCCTACAATCCCCAAAGYCA | (SEQ ID NO: 14634) |

TABLE 11-continued

| | | |
|---|---|---|
| 148 | +GAA + TTTG + GVATYCCCTACAATCCCCAAAGYCA | (SEQ ID NO: 14635) |
| 148 | +GAATTTG + GVA + TYCCCTACAATCCCCAAAGYCA | (SEQ ID NO: 14636) |
| 148 | +GAA + TTTGGVA + TYCCCTACAATCCCCAAAGYCA | (SEQ ID NO: 14637) |
| 148 | +TTTG + GVA + TYCCCTACAATCCCCAAAGYCA | (SEQ ID NO: 14638) |
| 148 | +TTTGGVA + TY + CCCTACAATCCCCAAAGYCA | (SEQ ID NO: 14639) |
| 148 | +TTTG + GVATY + CCCTACAATCCCCAAAGYCA | (SEQ ID NO: 14640) |
| 148 | +GVA + TY + CCCTACAATCCCCAAAGYCA | (SEQ ID NO: 14641) |
| 148 | +GVATY + C + CCTACAATCCCCAAAGYCA | (SEQ ID NO: 14642) |
| 148 | +GVA + TYC + CCTACAATCCCCAAAGYCA | (SEQ ID NO: 14643) |
| 148 | BR + TCMMR + C + ARGAATTTGGVATYCCCTACAATCCCCAAAGY | (SEQ ID NO: 14644) |
| 148 | BR + TCMMRC + AR + GAATTTGGVATYCCCTACAATCCCCAAAGY | (SEQ ID NO: 14645) |
| 148 | BR + TCMMR + CAR + GAATTTGGVATYCCCTACAATCCCCAAAGY | (SEQ ID NO: 14646) |
| 148 | +C + AR + GAATTTGGVATYCCCTACAATCCCCAAAGY | (SEQ ID NO: 14647) |
| 148 | +CAR + GAA + TTTGGVATYCCCTACAATCCCCAAAGY | (SEQ ID NO: 14648) |
| 148 | +C + ARGAA + TTTGGVATYCCCTACAATCCCCAAAGY | (SEQ ID NO: 14649) |
| 148 | +AR + GAA + TTTGGVATYCCCTACAATCCCCAAAGY | (SEQ ID NO: 14650) |
| 148 | +ARGAA + TTTG + GVATYCCCTACAATCCCCAAAGY | (SEQ ID NO: 14651) |
| 148 | +AR + GAATTTG + GVATYCCCTACAATCCCCAAAGY | (SEQ ID NO: 14652) |
| 148 | +GAA + TTTG + GVATYCCCTACAATCCCCAAAGY | (SEQ ID NO: 14653) |
| 148 | +GAATTTG + GVA + TYCCCTACAATCCCCAAAGY | (SEQ ID NO: 14654) |
| 148 | +GAA + TTTGGVA + TYCCCTACAATCCCCAAAGY | (SEQ ID NO: 14655) |
| 148 | +TTTG + GVA + TYCCCTACAATCCCCAAAGY | (SEQ ID NO: 14656) |
| 148 | +TTTGGVA + TY + CCCTACAATCCCCAAAGY | (SEQ ID NO: 14657) |
| 148 | +TTTG + GVATY + CCCTACAATCCCCAAAGY | (SEQ ID NO: 14658) |
| 148 | +GVA + TY + CCCTACAATCCCCAAAGY | (SEQ ID NO: 14659) |
| 148 | +GVATY + C + CCTACAATCCCCAAAGY | (SEQ ID NO: 14660) |
| 148 | +GVA + TYC + CCTACAATCCCCAAAGY | (SEQ ID NO: 14661) |
| 148 | R + TCMMR + C + ARGAATTTGGVATYCCCTACAATCCCCAAAGYC | (SEQ ID NO: 14662) |
| 148 | R + TCMMRC + AR + GAATTTGGVATYCCCTACAATCCCCAAAGYC | (SEQ ID NO: 14663) |
| 148 | R + TCMMR + CAR + GAATTTGGVATYCCCTACAATCCCCAAAGYC | (SEQ ID NO: 14664) |
| 148 | +C + AR + GAATTTGGVATYCCCTACAATCCCCAAAGYC | (SEQ ID NO: 14665) |
| 148 | +CAR + GAA + TTTGGVATYCCCTACAATCCCCAAAGYC | (SEQ ID NO: 14666) |
| 148 | +C + ARGAA + TTTGGVATYCCCTACAATCCCCAAAGYC | (SEQ ID NO: 14667) |
| 148 | +AR + GAA + TTTGGVATYCCCTACAATCCCCAAAGYC | (SEQ ID NO: 14668) |
| 148 | +ARGAA + TTTG + GVATYCCCTACAATCCCCAAAGYC | (SEQ ID NO: 14669) |
| 148 | +AR + GAATTTG + GVATYCCCTACAATCCCCAAAGYC | (SEQ ID NO: 14670) |
| 148 | +GAA + TTTG + GVATYCCCTACAATCCCCAAAGYC | (SEQ ID NO: 14671) |

TABLE 11-continued

| | |
|---|---|
| 148 | +GAATTTG + GVA + TYCCCTACAATCCCCAAAGYC (SEQ ID NO: 14672) |
| 148 | +GAA + TTTGGVA + TYCCCTACAATCCCCAAAGYC (SEQ ID NO: 14673) |
| 148 | +TTTG + GVA + TYCCCTACAATCCCCAAAGYC (SEQ ID NO: 14674) |
| 148 | +TTTGGVA + TY + CCCTACAATCCCCAAAGYC (SEQ ID NO: 14675) |
| 148 | +TTTG + GVATY + CCCTACAATCCCCAAAGYC (SEQ ID NO: 14676) |
| 148 | +GVA + TY + CCCTACAATCCCCAAAGYC (SEQ ID NO: 14677) |
| 148 | +GVATY + C + CCTACAATCCCCAAAGYC (SEQ ID NO: 14678) |
| 148 | +GVA + TYC + CCTACAATCCCCAAAGYC (SEQ ID NO: 14679) |
| 148 | TCMMRCARGAATTTGGVATYCCCTACAATCCCCAAAGYCA (SEQ ID NO: 14680) |
| 148 | CARGAATTTGGVATYCCCTACAATCCCCAAAGYCA (SEQ ID NO: 14681) |
| 148 | ARGAATTTGGVATYCCCTACAATCCCCAAAGYCA (SEQ ID NO: 14682) |
| 148 | GAATTTGGVATYCCCTACAATCCCCAAAGYCA (SEQ ID NO: 14683) |
| 148 | TTTGGVATYCCCTACAATCCCCAAAGYCA (SEQ ID NO: 14684) |
| 148 | GVATYCCCTACAATCCCCAAAGYCA (SEQ ID NO: 14685) |
| 148 | BRTCMMRCARGAATTTGGVATYCCCTACAATCCCCAAAGY (SEQ ID NO: 14686) |
| 148 | CARGAATTTGGVATYCCCTACAATCCCCAAAGY (SEQ ID NO: 14687) |
| 148 | ARGAATTTGGVATYCCCTACAATCCCCAAAGY (SEQ ID NO: 14688) |
| 148 | GAATTTGGVATYCCCTACAATCCCCAAAGY (SEQ ID NO: 14689) |
| 148 | TTTGGVATYCCCTACAATCCCCAAAGY (SEQ ID NO: 14690) |
| 148 | GVATYCCCTACAATCCCCAAAGY (SEQ ID NO: 14691) |
| 148 | RTCMMRCARGAATTTGGVATYCCCTACAATCCCCAAAGYC (SEQ ID NO: 14692) |
| 148 | CARGAATTTGGVATYCCCTACAATCCCCAAAGYC (SEQ ID NO: 14693) |
| 148 | ARGAATTTGGVATYCCCTACAATCCCCAAAGYC (SEQ ID NO: 14694) |
| 148 | GAATTTGGVATYCCCTACAATCCCCAAAGYC (SEQ ID NO: 14695) |
| 148 | TTTGGVATYCCCTACAATCCCCAAAGYC (SEQ ID NO: 14696) |
| 148 | GVATYCCCTACAATCCCCAAAGYC (SEQ ID NO: 14697) |
| 148 | GCVRRDRTYMVRCARGARTTTGGVATYCCCTACAATCCYCAAAGT (SEQ ID NO: 14698) |
| 148 | TCMMRCARGAATTTGGVATYCCCTACAATCCCCAAAGYCA + N (SEQ ID NO: 14699) |
| 148 | CARGAATTTGGVATYCCCTACAATCCCCAAAGYCA + N (SEQ ID NO: 14700) |
| 148 | ARGAATTTGGVATYCCCTACAATCCCCAAAGYCA + N (SEQ ID NO: 14701) |
| 148 | GAATTTGGVATYCCCTACAATCCCCAAAGYCA + N (SEQ ID NO: 14702) |
| 148 | TTTGGVATYCCCTACAATCCCCAAAGYCA + N (SEQ ID NO: 14703) |
| 148 | GVATYCCCTACAATCCCCAAAGYCA + N (SEQ ID NO: 14704) |
| 148 | BRTCMMRCARGAATTTGGVATYCCCTACAATCCCCAAAGY + N (SEQ ID NO: 14705) |
| 148 | CARGAATTTGGVATYCCCTACAATCCCCAAAGY + N (SEQ ID NO: 14706) |
| 148 | ARGAATTTGGVATYCCCTACAATCCCCAAAGY + N (SEQ ID NO: 14707) |
| 148 | GAATTTGGVATYCCCTACAATCCCCAAAGY + N (SEQ ID NO: 14708) |
| 148 | TTTGGVATYCCCTACAATCCCCAAAGY + N (SEQ ID NO: 14709) |

TABLE 11-continued

| | |
|---|---|
| 148 | GVATYCCCTACAATCCCCAAAGY + N (SEQ ID NO: 14710) |
| 148 | RTCMMRCARGAATTTGGVATYCCCTACAATCCCCAAAGYC + N (SEQ ID NO: 14711) |
| 148 | CARGAATTTGGVATYCCCTACAATCCCCAAAGYC + N (SEQ ID NO: 14712) |
| 148 | ARGAATTTGGVATYCCCTACAATCCCCAAAGYC + N (SEQ ID NO: 14713) |
| 148 | GAATTTGGVATYCCCTACAATCCCCAAAGYC + N (SEQ ID NO: 14714) |
| 148 | TTTGGVATYCCCTACAATCCCCAAAGYC + N (SEQ ID NO: 14715) |
| 148 | GVATYCCCTACAATCCCCAAAGYC + N (SEQ ID NO: 14716) |
| 148 | GCVRRDRTYMVRCARGARTTTGGVATYCCCTACAATCCYCAAAGT + N (SEQ ID NO: 14717) |
| 153 | GARTTTGGVATYCCCTACAATCCYCAAAGYCARGGAGTAGTAGAA (SEQ ID NO: 14718) |
| 153 | GARTTTGGVATYCCCTACAATCCYCAAAGYCARGGAGTAGTAGAA + N (SEQ ID NO: 14719) |
| 155 | Y + C + CC + TACAATCCCCAAAGYCARGGAGTAGTRGARTCYATG (SEQ ID NO: 14720) |
| 155 | Y + CCC + T + ACAATCCCCAAAGYCARGGAGTAGTRGARTCYATG (SEQ ID NO: 14721) |
| 155 | Y + C + CCT + ACAATCCCCAAAGYCARGGAGTAGTRGARTCYATG (SEQ ID NO: 14722) |
| 155 | +CC + T + ACAATCCCCAAAGYCARGGAGTAGTRGARTCYATG (SEQ ID NO: 14723) |
| 155 | +CCT + AC + AATCCCCAAAGYCARGGAGTAGTRGARTCYATG (SEQ ID NO: 14724) |
| 155 | +CC + TAC + AATCCCCAAAGYCARGGAGTAGTRGARTCYATG (SEQ ID NO: 14725) |
| 155 | +T + AC + AATCCCCAAAGYCARGGAGTAGTRGARTCYATG (SEQ ID NO: 14726) |
| 155 | +TAC + A + ATCCCCAAAGYCARGGAGTAGTRGARTCYATG (SEQ ID NO: 14727) |
| 155 | +T + ACA + ATCCCCAAAGYCARGGAGTAGTRGARTCYATG (SEQ ID NO: 14728) |
| 155 | +AC + A + ATCCCCAAAGYCARGGAGTAGTRGARTCYATG (SEQ ID NO: 14729) |
| 155 | +ACA + AT + CCCCAAAGYCARGGAGTAGTRGARTCYATG (SEQ ID NO: 14730) |
| 155 | +AC + AAT + CCCCAAAGYCARGGAGTAGTRGARTCYATG (SEQ ID NO: 14731) |
| 155 | +A + AT + CCCCAAAGYCARGGAGTAGTRGARTCYATG (SEQ ID NO: 14732) |
| 155 | +AAT + C + CCCAAAGYCARGGAGTAGTRGARTCYATG (SEQ ID NO: 14733) |
| 155 | +A + ATC + CCCAAAGYCARGGAGTAGTRGARTCYATG (SEQ ID NO: 14734) |
| 155 | +AT + C + CCCAAAGYCARGGAGTAGTRGARTCYATG (SEQ ID NO: 14735) |
| 155 | +ATC + CC + CAAAGYCARGGAGTAGTRGARTCYATG (SEQ ID NO: 14736) |
| 155 | +AT + CCC + CAAAGYCARGGAGTAGTRGARTCYATG (SEQ ID NO: 14737) |
| 155 | +C + CC + TACAATCCCCAAAGYCARGGAGTAGTRGARTCYATGA (SEQ ID NO: 14738) |
| 155 | +CCC + T + ACAATCCCCAAAGYCARGGAGTAGTRGARTCYATGA (SEQ ID NO: 14739) |
| 155 | +C + CCT + ACAATCCCCAAAGYCARGGAGTAGTRGARTCYATGA (SEQ ID NO: 14740) |
| 155 | +CC + T + ACAATCCCCAAAGYCARGGAGTAGTRGARTCYATGA (SEQ ID NO:14741) |
| 155 | +CCT + AC + AATCCCCAAAGYCARGGAGTAGTRGARTCYATGA (SEQ ID NO: 14742) |
| 155 | +CC + TAC + AATCCCCAAAGYCARGGAGTAGTRGARTCYATGA (SEQ ID NO: 14743) |

TABLE 11-continued

| | |
|---|---|
| 155 | +T + AC + AATCCCCAAAGYCARGGAGTAGTRGARTCYATGA (SEQ ID NO: 14744) |
| 155 | +TAC + A + ATCCCCAAAGYCARGGAGTAGTRGARTCYATGA (SEQ ID NO: 14745) |
| 155 | +T + ACA + ATCCCCAAAGYCARGGAGTAGTRGARTCYATGA (SEQ ID NO: 14746) |
| 155 | +AC + A + ATCCCCAAAGYCARGGAGTAGTRGARTCYATGA (SEQ ID NO: 14747) |
| 155 | +ACA + AT + CCCCAAAGYCARGGAGTAGTRGARTCYATGA (SEQ ID NO: 14748) |
| 155 | +AC + AAT + CCCCAAAGYCARGGAGTAGTRGARTCYATGA (SEQ ID NO: 14749) |
| 155 | +A + AT + CCCCAAAGYCARGGAGTAGTRGARTCYATGA (SEQ ID NO: 14750) |
| 155 | +AAT + C + CCCAAAGYCARGGAGTAGTRGARTCYATGA (SEQ ID NO: 14751) |
| 155 | +A + ATC + CCCAAAGYCARGGAGTAGTRGARTCYATGA (SEQ ID NO: 14752) |
| 155 | +AT + C + CCCAAAGYCARGGAGTAGTRGARTCYATGA (SEQ ID NO: 14753) |
| 155 | +ATC + CC + CAAAGYCARGGAGTAGTRGARTCYATGA (SEQ ID NO: 14754) |
| 155 | +AT + CCC + CAAAGYCARGGAGTAGTRGARTCYATGA (SEQ ID NO: 14755) |
| 155 | YCCCTACAATCCCCAAAGYCARGGAGTAGTRGARTCYATG (SEQ ID NO: 14756) |
| 155 | CCTACAATCCCCAAAGYCARGGAGTAGTRGARTCYATG (SEQ ID NO: 14757) |
| 155 | TACAATCCCCAAAGYCARGGAGTAGTRGARTCYATG (SEQ ID NO: 14758) |
| 155 | ACAATCCCCAAAGYCARGGAGTAGTRGARTCYATG (SEQ ID NO: 14759) |
| 155 | AATCCCCAAAGYCARGGAGTAGTRGARTCYATG (SEQ ID NO: 14760) |
| 155 | ATCCCCAAAGYCARGGAGTAGTRGARTCYATG (SEQ ID NO: 14761) |
| 155 | CCCTACAATCCCCAAAGYCARGGAGTAGTRGARTCYATGA (SEQ ID NO: 14762) |
| 155 | CCTACAATCCCCAAAGYCARGGAGTAGTRGARTCYATGA (SEQ ID NO: 14763) |
| 155 | TACAATCCCCAAAGYCARGGAGTAGTRGARTCYATGA (SEQ ID NO: 14764) |
| 155 | ACAATCCCCAAAGYCARGGAGTAGTRGARTCYATGA (SEQ ID NO: 14765) |
| 155 | AATCCCCAAAGYCARGGAGTAGTRGARTCYATGA (SEQ ID NO: 14766) |
| 155 | ATCCCCAAAGYCARGGAGTAGTRGARTCYATGA (SEQ ID NO: 14767) |
| 155 | GGVATYCCCTACAATCCYCAAAGYCARGGAGTAGTRGARTCTATG (SEQ ID NO: 14768) |
| 155 | YCCCTACAATCCCCAAAGYCARGGAGTAGTRGARTCYATG + N (SEQ ID NO: 14769) |
| 155 | CCTACAATCCCCAAAGYCARGGAGTAGTRGARTCYATG + N (SEQ ID NO: 14770) |
| 155 | TACAATCCCCAAAGYCARGGAGTAGTRGARTCYATG + N (SEQ ID NO: 14771) |
| 155 | ACAATCCCCAAAGYCARGGAGTAGTRGARTCYATG + N (SEQ ID NO: 14772) |
| 155 | AATCCCCAAAGYCARGGAGTAGTRGARTCYATG + N (SEQ ID NO: 14773) |
| 155 | ATCCCCAAAGYCARGGAGTAGTRGARTCYATG + N (SEQ ID NO: 14774) |
| 155 | CCCTACAATCCCCAAAGYCARGGAGTAGTRGARTCYATGA + N (SEQ ID NO: 14775) |
| 155 | CCTACAATCCCCAAAGYCARGGAGTAGTRGARTCYATGA + N (SEQ ID NO: 14776) |
| 155 | TACAATCCCCAAAGYCARGGAGTAGTRGARTCYATGA + N (SEQ ID NO: 14777) |
| 155 | ACAATCCCCAAAGYCARGGAGTAGTRGARTCYATGA + N (SEQ ID NO: 14778) |

TABLE 11-continued

| | |
|---|---|
| 155 | AATCCCCAAAGYCARGGAGTAGTRGARTCYATGA + N (SEQ ID NO: 14779) |
| 155 | ATCCCCAAAGYCARGGAGTAGTRGARTCYATGA + N (SEQ ID NO: 14780) |
| 155 | GGVATYCCCTACAATCCYCAAAGYCARGGAGTAGTRGARTCTATG + N (SEQ ID NO: 14781) |
| 163 | A + GTAGTRG + ARTCYATGA + ATAARGAATTAAAGAAAATYATA (SEQ ID NO: 14782) |
| 163 | A + GTAGTRGARTCYATGA + ATAARGAAT + TAAAGAAAATYATA (SEQ ID NO: 14783) |
| 163 | A + GTAGTRG + ARTCYATGAATAARGAAT + TAAAGAAAATYATA (SEQ ID NO: 14784) |
| 163 | +ARTCYATGA + ATAARGAAT + TAAAGAAAATYATA (SEQ ID NO: 14785) |
| 163 | +ARTCYATGAATAARGAAT + TA + AGAAAATYATA (SEQ ID NO: 14786) |
| 163 | +ARTCYATGA + ATAARGAATTA + AGAAAATYATA (SEQ ID NO: 14787) |
| 163 | +ATAARGAAT + TA + AGAAAATYATA (SEQ ID NO: 14788) |
| 163 | +ATAARGAATTA + AAGAAAA + TYATA (SEQ ID NO: 14789) |
| 163 | +ATAARGAAT + TAAAGAAAA + TYATA (SEQ ID NO: 14790) |
| 163 | AGTAGTRGARTCYATGAATAARGAATTAAAGAAAATYATA (SEQ ID NO: 14791) |
| 163 | ARTCYATGAATAARGAATTAAAGAAAATYATA (SEQ ID NO: 14792) |
| 163 | ATAARGAATTAAAGAAAATYATA (SEQ ID NO: 14793) |
| 163 | CARGGAGTAGTRGARTCYATGAATAADGARTTAAAGAARATTATA (SEQ ID NO: 14794) |
| 163 | AGTAGTRGARTCYATGAATAARGAATTAAAGAAAATYATA + N (SEQ ID NO: 14795) |
| 163 | ARTCYATGAATAARGAATTAAAGAAAATYATA + N (SEQ ID NO: 14796) |
| 163 | ATAARGAATTAAAGAAAATYATA + N (SEQ ID NO: 14797) |
| 163 | CARGGAGTAGTRGARTCYATGAATAADGARTTAAAGAARATTATA + N (SEQ ID NO: 14798) |
| 230 | AA + TTWYAAAAA + TTCAAAAT + TTTCGGGTTTATTACAGRGAC (SEQ ID NO: 14799) |
| 230 | AA + TTWYAAAAATTCAAAAT + T + TTCGGGTTTATTACAGRGAC (SEQ ID NO: 14800) |
| 230 | AA + TTWYAAAAA + TTCAAAATT + TTCGGGTTTATTACAGRGAC (SEQ ID NO :14801) |
| 230 | +TTCAAAAT + T + TTCGGGTTTATTACAGRGAC (SEQ ID NO: 14802) |
| 230 | +TTCAAAATT + TT + CGGGTTTATTACAGRGAC (SEQ ID NO: 14803) |
| 230 | +TTCAAAAT + TTT + CGGGTTTATTACAGRGAC (SEQ ID NO: 14804) |
| 230 | +T + TT + CGGGTTTATTACAGRGAC (SEQ ID NO: 14805) |
| 230 | +TTT + CG + GGTTTATTACAGRGAC (SEQ ID NO: 14806) |
| 230 | +T + TTCG + GGTTTATTACAGRGAC (SEQ ID NO: 14807) |
| 230 | AATTWYAAAAATTCAAAATTTTCGGGTTTATTACAGRGAC (SEQ ID NO: 14808) |
| 230 | TTCAAAATTTTCGGGTTTATTACAGRGAC (SEQ ID NO: 14809) |
| 230 | TTTCGGGTTTATTACAGRGAC (SEQ ID NO: 14810) |
| 230 | AAMCARATTWYAAAAATTCAAAATTTTCGGGTTTATTACAGGGAC (SEQ ID NO: 14811) |
| 230 | AATTWYAAAAATTCAAAATTTTCGGGTTTATTACAGRGAC + N (SEQ ID NO: 14812) |
| 230 | TTCAAAATTTTCGGGTTTATTACAGRGAC + N (SEQ ID NO: 14813) |

TABLE 11-continued

| | |
|---|---|
| 230 | TTTCGGGTTTATTACAGRGAC + N (SEQ ID NO: 14814) |
| 230 | AAMCARATTWYAAAAATTCAAAATTTTCGGGTTTATTACAGGGAC + N (SEQ ID NO: 14815) |
| 263 | GTRM + TA + C + ARGAYAAYARYGAHATAAARGTAGTRCCAAGRA (SEQ ID NO: 14816) |
| 263 | GTRM + TAC + ARG + AYAAYARYGAHATAAARGTAGTRCCAAGRA (SEQ ID NO: 14817) |
| 263 | GTRM + TA + CARG + AYAAYARYGAHATAAARGTAGTRCCAAGRA (SEQ ID NO: 14818) |
| 263 | +C + ARG + AYAAYARYGAHATAAARGTAGTRCCAAGRA (SEQ ID NO: 14819) |
| 263 | +CARG + AYAAYARY + GAHATAAARGTAGTRCCAAGRA (SEQ ID NO: 14820) |
| 263 | +C + ARGAYAAYARY + GAHATAAARGTAGTRCCAAGRA (SEQ ID NO: 14821) |
| 263 | +ARG + AYAAYARY + GAHATAAARGTAGTRCCAAGRA (SEQ ID NO: 14822) |
| 263 | +ARGAYAAYARY + GAHA + TAAARGTAGTRCCAAGRA (SEQ ID NO: 14823) |
| 263 | +ARG + AYAAYARYGAHA + TAAARGTAGTRCCAAGRA (SEQ ID NO: 14824) |
| 263 | +AYAAYARY + GAHA + TAAARGTAGTRCCAAGRA (SEQ ID NO: 14825) |
| 263 | +AYAAYARYGAHA + TA + AARGTAGTRCCAAGRA (SEQ ID NO: 14826) |
| 263 | +AYAAYARY + GAHATA + AARGTAGTRCCAAGRA (SEQ ID NO: 14827) |
| 263 | +GAHA + TA + AARGTAGTRCCAAGRA (SEQ ID NO: 14828) |
| 263 | +GAHATA + A + ARGTAGTRCCAAGRA (SEQ ID NO: 14829) |
| 263 | +GAHA + TAA + ARGTAGTRCCAAGRA (SEQ ID NO: 14830) |
| 263 | GTRMTACARGAYAAYARYGAHATAAARGTAGTRCCAAGRA (SEQ ID NO: 14831) |
| 263 | CARGAYAAYARYGAHATAAARGTAGTRCCAAGRA (SEQ ID NO: 14832) |
| 263 | ARGAYAAYARYGAHATAAARGTAGTRCCAAGRA (SEQ ID NO: 14833) |
| 263 | AYAAYARYGAHATAAARGTAGTRCCAAGRA (SEQ ID NO: 14834) |
| 263 | GAHATAAARGTAGTRCCAAGRA (SEQ ID NO: 14835) |
| 263 | GCAGTAGTVATACARGAYAAYARTGAHATAAARGTAGTRCCAAGA (SEQ ID NO: 14836) |
| 263 | GTRMTACARGAYAAYARYGAHATAAARGTAGTRCCAAGRA + N (SEQ ID NO: 14837) |
| 263 | CARGAYAAYARYGAHATAAARGTAGTRCCAAGRA + N (SEQ ID NO: 14838) |
| 263 | ARGAYAAYARYGAHATAAARGTAGTRCCAAGRA + N (SEQ ID NO: 14839) |
| 263 | AYAAYARYGAHATAAARGTAGTRCCAAGRA + N (SEQ ID NO: 14840) |
| 263 | GAHATAAARGTAGTRCCAAGRA + N (SEQ ID NO: 14841) |
| 263 | GCAGTAGTVATACARGAYAAYARTGAHATAAARGTAGTRCCAAGA + N (SEQ ID NO: 14842) |

| Codon | Reverse Primer (5' to ') |
|---|---|
| 51 | ARRTGTGTRCARTCTARYTGCCATATYCCTGGRCTRCARTCYACYTGTCC (SEQ ID NO:14843) |
| 51 | ARRTGTGTRCARTCTARYTGCCATATYCCTGGRCTRCARTCYACYTGTCC (SEQ ID NO:14844) |
| 51 | ARRTGTGTRCARTCTARYTGCCATATYCCTGGRCTRCARTCYACYTGTCC + N (SEQ ID NO: 14845) |
| 66 | +AC + R + TGRACTGCTACYADRATDAYTTTYCCTTCTARRTGTG (SEQ ID NO: 14846) |
| 66 | +ACR + TGR + ACTGCTACYADRATDAYTTTYCCTTCTARRTGTG (SEQ ID NO: 14847) |
| 66 | +AC + RTGR + ACTGCTACYADRATDAYTTTYCCTTCTARRTGTG (SEQ ID NO: 14848) |

TABLE 11-continued

| | | |
|---|---|---|
| 66 | +R + TGR + ACTGCTACYADRATDAYTTTYCCTTCTARRTGTG | (SEQ ID NO: 14849) |
| 66 | +RTGR + AC + TGCTACYADRATDAYTTTYCCTTCTARRTGTG | (SEQ ID NO: 14850) |
| 66 | +R + TGRAC + TGCTACYADRATDAYTTTYCCTTCTARRTGTG | (SEQ ID NO: 14851) |
| 66 | +TGR + AC + TGCTACYADRATDAYTTTYCCTTCTARRTGTG | (SEQ ID NO: 14852) |
| 66 | +TGRAC + T + GCTACYADRATDAYTTTYCCTTCTARRTGTG | (SEQ ID NO: 14853) |
| 66 | +TGR + ACT + GCTACYADRATDAYTTTYCCTTCTARRTGTG | (SEQ ID NO: 14854) |
| 66 | +AC + T + GCTACYADRATDAYTTTYCCTTCTARRTGTG | (SEQ ID NO: 14855) |
| 66 | +ACT + GC + TACYADRATDAYTTTYCCTTCTARRTGTG | (SEQ ID NO: 14856) |
| 66 | +AC + TGC + TACYADRATDAYTTTYCCTTCTARRTGTG | (SEQ ID NO: 14857) |
| 66 | +T + GC + TACYADRATDAYTTTYCCTTCTARRTGTG | (SEQ ID NO: 14858) |
| 66 | +TGC + TACYADRATD + AYTTTYCCTTCTARRTGTG | (SEQ ID NO: 14859) |
| 66 | +T + GCTACYADRATD + AYTTTYCCTTCTARRTGTG | (SEQ ID NO: 14860) |
| 66 | +GC + TACYADRATD + AYTTTYCCTTCTARRTGTG | (SEQ ID NO: 14861) |
| 66 | +GCTACYADRATD + AYT + TTYCCTTCTARRTGTG | (SEQ ID NO: 14862) |
| 66 | +GC + TACYADRATDAYT + TTYCCTTCTARRTGTG | (SEQ ID NO: 14863) |
| 66 | Y + A + CRT + GRACTGCTACYADRATDAYTTTYCCTTCTARRTGT | (SEQ ID NO: 14864) |
| 66 | Y + ACRT + GR + ACTGCTACYADRATDAYTTTYCCTTCTARRTGTG | (SEQ ID NO: 14865) |
| 66 | Y + A + CRTGR + ACTGCTACYADRATDAYTTTYCCTTCTARRTGT | (SEQ ID NO: 14866) |
| 66 | +CRT + GR + ACTGCTACYADRATDAYTTTYCCTTCTARRTGT | (SEQ ID NO: 14867) |
| 66 | +CRTGR + A + CTGCTACYADRATDAYTTTYCCTTCTARRTGT | (SEQ ID NO: 14868) |
| 66 | +CRT + GRA + CTGCTACYADRATDAYTTTYCCTTCTARRTGT | (SEQ ID NO: 14869) |
| 66 | +GR + A + CTGCTACYADRATDAYTTTYCCTTCTARRTGT | (SEQ ID NO: 14870) |
| 66 | +GRA + CT + GCTACYADRATDAYTTTYCCTTCTARRTGT | (SEQ ID NO: 14871) |
| 66 | +GR + ACT + GCTACYADRATDAYTTTYCCTTCTARRTGT | (SEQ ID NO: 14872) |
| 66 | +A + CT + GCTACYADRATDAYTTTYCCTTCTARRTGT | (SEQ ID NO: 14873) |
| 66 | +ACT + GCTACYADRA + TDAYTTTYCCTTCTARRTGT | (SEQ ID NO: 14874) |
| 66 | +A + CTGCTACYADRA + TDAYTTTYCCTTCTARRTGT | (SEQ ID NO: 14875) |
| 66 | +CT + GCTACYADRA + TDAYTTTYCCTTCTARRTGT | (SEQ ID NO: 14876) |
| 66 | +CTGCTACYADRA + TDA + YTTTYCCTTCTARRTGT | (SEQ ID NO: 14877) |
| 66 | +CT + GCTACYADRATDA + YTTTYCCTTCTARRTGT | (SEQ ID NO: 14878) |
| 66 | +GCTACYADRA + TDA + YTTTYCCTTCTARRTGT | (SEQ ID NO: 14879) |
| 66 | +GCTACYADRATDA + YT + TTYCCTTCTARRTGT | (SEQ ID NO: 14880) |
| 66 | +GCTACYADRA + TDAYT + TTYCCTTCTARRTGT | (SEQ ID NO: 14881) |
| 66 | ACRTGRACTGCTACYADRATDAYTTTYCCTTCTARRTGTG | (SEQ ID NO: 14882) |
| 66 | RTGRACTGCTACYADRATDAYTTTYCCTTCTARRTGTG | (SEQ ID NO: 14883) |
| 66 | TGRACTGCTACYADRATDAYTTTYCCTTCTARRTGTG | (SEQ ID NO: 14884) |
| 66 | ACTGCTACYADRATDAYTTTYCCTTCTARRTGTG | (SEQ ID NO: 14885) |

| | TABLE 11-continued | |
|---|---|---|
| 66 | TGCTACYADRATDAYTTTYCCTTCTARRTGTG (SEQ ID NO: 14886) | |
| 66 | GCTACYADRATDAYTTTYCCTTCTARRTGTG (SEQ ID NO: 14887) | |
| 66 | YACRTGRACTGCTACYADRATDAYTTTYCCTTCTARRTGT (SEQ ID NO: 14888) | |
| 66 | CRTGRACTGCTACYADRATDAYTTTYCCTTCTARRTGT (SEQ ID NO: 14889) | |
| 66 | GRACTGCTACYADRATDAYTTTYCCTTCTARRTGT (SEQ ID NO: 14890) | |
| 66 | ACTGCTACYADRATDAYTTTYCCTTCTARRTGT (SEQ ID NO: 14891) | |
| 66 | CTGCTACYADRATDAYTTTYCCTTCTARRTGT (SEQ ID NO: 14892) | |
| 66 | GCTACYADRATDAYTTTYCCTTCTARRTGT (SEQ ID NO: 14893) | |
| 66 | RTABCCACTRGCYACRTGRACTGCTACYAKRATDAYTTTYCCTTCTAAATG (SEQ ID NO: 14894) | |
| 66 | ACRTGRACTGCTACYADRATDAYTTTYCCTTCTARRTGTG + N (SEQ ID NO: 14895) | |
| 66 | RTGRACTGCTACYADRATDAYTTTYCCTTCTARRTGTG + N (SEQ ID NO: 14896) | |
| 66 | TGRACTGCTACYADRATDAYTTTYCCTTCTARRTGTG + N (SEQ ID NO: 14897) | |
| 66 | ACTGCTACYADRATDAYTTTYCCTTCTARRTGTG + N (SEQ ID NO: 14898) | |
| 66 | TGCTACYADRATDAYTTTYCCTTCTARRTGTG + N (SEQ ID NO: 14899) | |
| 66 | GCTACYADRATDAYTTTYCCTTCTARRTGTG + N (SEQ ID NO: 14900) | |
| 66 | YACRTGRACTGCTACYADRATDAYTTTYCCTTCTARRTGT + N (SEQ ID NO: 14901) | |
| 66 | CRTGRACTGCTACYADRATDAYTTTYCCTTCTARRTGT + N (SEQ ID NO: 14902) | |
| 66 | GRACTGCTACYADRATDAYTTTYCCTTCTARRTGT + N (SEQ ID NO: 14903) | |
| 66 | ACTGCTACYADRATDAYTTTYCCTTCTARRTGT + N (SEQ ID NO: 14904) | |
| 66 | CTGCTACYADRATDAYTTTYCCTTCTARRTGT + N (SEQ ID NO: 14905) | |
| 66 | GCTACYADRATDAYTTTYCCTTCTARRTGT + N (SEQ ID NO: 14906) | |
| 66 | RTABCCACTRGCYACRTGRACTGCTACYAKRATDAYTTTYCCTTCTAAATG + N (SEQ ID NO: 14907) | |
| 74 | +TC + T + GCTTCYATRTADCCACTRGCYACRTGRACTGCTACYA (SEQ ID NO: 14908) | |
| 74 | +TCT + GC + TTCYATRTADCCACTRGCYACRTGRACTGCTACYA (SEQ ID NO: 14909) | |
| 74 | +TC + TGC + TTCYATRTADCCACTRGCYACRTGRACTGCTACYA (SEQ ID NO: 14910) | |
| 74 | +T + GC + TTCYATRTADCCACTRGCYACRTGRACTGCTACYA (SEQ ID NO: 14911) | |
| 74 | +TGC + T + TCYATRTADCCACTRGCYACRTGRACTGCTACYA (SEQ ID NO: 14912) | |
| 74 | +T + GCT + TCYATRTADCCACTRGCYACRTGRACTGCTACYA (SEQ ID NO: 14913) | |
| 74 | +GC + T + TCYATRTADCCACTRGCYACRTGRACTGCTACYA (SEQ ID NO: 14914) | |
| 74 | +GCT + TCYAT + RTADCCACTRGCYACRTGRACTGCTACYA (SEQ ID NO:14915) | |
| 74 | +GC + TTCYAT + RTADCCACTRGCYACRTGRACTGCTACYA (SEQ ID NO:14916) | |
| 74 | +T + TCYAT + RTADCCACTRGCYACRTGRACTGCTACYA (SEQ ID NO: 14917) | |
| 74 | +TTCYAT + R + TADCCACTRGCYACRTGRACTGCTACYA (SEQ ID NO: 14918) | |

TABLE 11-continued

| | |
|---|---|
| 74 | +T + TCYATR + TADCCACTRGCYACRTGRACTGCTACYA (SEQ ID NO: 14919) |
| 74 | +TCYAT + R + TADCCACTRGCYACRTGRACTGCTACYA (SEQ ID NO: 14920) |
| 74 | +TCYATR + TA + DCCACTRGCYACRTGRACTGCTACYA (SEQ ID NO: 14921) |
| 74 | +TCYAT + RTA + DCCACTRGCYACRTGRACTGCTACYA (SEQ ID NO: 14922) |
| 74 | +R + TA + DCCACTRGCYACRTGRACTGCTACYA (SEQ ID NO: 14923) |
| 74 | +RTA + D + CCACTRGCYACRTGRACTGCTACYA (SEQ ID NO: 14924) |
| 74 | +R + TAD + CCACTRGCYACRTGRACTGCTACYA (SEQ ID NO: 14925) |
| 74 | TCTGCTTCYATRTADCCACTRGCYACRTGRACTGCTACYA (SEQ ID NO: 14926) |
| 74 | TGCTTCYATRTADCCACTRGCYACRTGRACTGCTACYA (SEQ ID NO: 14927) |
| 74 | GCTTCYATRTADCCACTRGCYACRTGRACTGCTACYA (SEQ ID NO: 14928) |
| 74 | TTCYATRTADCCACTRGCYACRTGRACTGCTACYA (SEQ ID NO: 14929) |
| 74 | TCYATRTADCCACTRGCYACRTGRACTGCTACYA (SEQ ID NO: 14930) |
| 74 | RTADCCACTRGCYACRTGRACTGCTACYA (SEQ ID NO :14931) |
| 74 | GCTGGRATRACYTCTGCTTCYATRTABCCACTRGCYACRTGRACTGCTAC (SEQ ID NO: 14932) |
| 74 | TCTGCTTCYATRTADCCACTRGCYACRTGRACTGCTACYA + N (SEQ ID NO: 14933) |
| 74 | TGCTTCYATRTADCCACTRGCYACRTGRACTGCTACYA + N (SEQ ID NO: 14934) |
| 74 | GCTTCYATRTADCCACTRGCYACRTGRACTGCTACYA + N (SEQ ID NO: 14935) |
| 74 | TTCYATRTADCCACTRGCYACRTGRACTGCTACYA + N (SEQ ID NO: 14936) |
| 74 | TCYATRTADCCACTRGCYACRTGRACTGCTACYA + N (SEQ ID NO: 14937) |
| 74 | RTADCCACTRGCYACRTGRACTGCTACYA + N (SEQ ID NO: 14938) |
| 74 | GCTGGRATRACYTCTGCTTCYATRTABCCACTRGCYACRTGRACTGCTAC + N (SEQ ID NO: 14939) |
| 92 | TGCTARYTTTARBAKRWARTATGCTG + TYTCYTGYC + CT + GTY (SEQ ID NO: 14940) |
| 92 | TGCTARYTTTARBAKRWARTATGCTG + TYTCYTGYCCT + G + TY (SEQ ID NO: 14941) |
| 92 | TGCTARYTTTARBAKRWARTATGCTG + TYTCYTGYC + CTG + TY (SEQ ID NO: 14942) |
| 92 | GCTARYTTTARBAKRWARTATGCTGTY + TCYTGYCCT + GT + YT (SEQ ID NO: 14943) |
| 92 | +GCTARYTTTARBAKRWARTATGCTGTY + TCYTGYCCTGT + YT (SEQ ID NO: 14944) |
| 92 | TGCTARYTTTARBAKRWARTATGCTGTYTCYTGYCCTGTY (SEQ ID NO: 14945) |
| 92 | GCTARYTTTARBAKRWARTATGCTGTYTCYTGYCCTGTYT (SEQ ID NO: 14946) |
| 92 | GGCCAYCTYCCTGCTARYTTTARNAKRWARTAKGCTGTYTCYTGYCCTGT (SEQ ID NO: 14947) |
| 92 | TGCTARYTTTARBAKRWARTATGCTGTYTCYTGYCCTGTY + N (SEQ ID NO: 14948) |
| 92 | GCTARYTTTARBAKRWARTATGCTGTYTCYTGYCCTGTYT + N (SEQ ID NO: 14949) |
| 92 | GGCCAYCTYCCTGCTARYTTTARNAKRWARTAKGCTGTYTCYTGYCCTGT + N (SEQ ID NO: 14950) |
| 97 | ACTGGCCAYCTT + CCTGCTARY + TT + TARBAKRWARTATGCTG (SEQ ID NO: 14951) |
| 97 | +ACTGGCCAYCTT + CCTGCTARYTT + TARBAKRWARTATGCTG (SEQ ID NO: 14952) |

TABLE 11-continued

| | |
|---|---|
| 97 | +TT + T + ARBAKRWARTATGCTG (SEQ ID NO: 14953) |
| 97 | +TTT + AR + BAKRWARTATGCTG (SEQ ID NO: 14954) |
| 97 | +TT + TAR + BAKRWARTATGCTG (SEQ ID NO: 14955) |
| 97 | +T + AR + BAKRWARTATGCTG (SEQ ID NO: 14956) |
| 97 | +TAR + BAKRWA + RTATGCTG (SEQ ID NO: 14957) |
| 97 | +T + ARBAKRWA + RTATGCTG (SEQ ID NO: 14958) |
| 97 | +AR + BAKRWA + RTATGCTG (SEQ ID NO: 14959) |
| 97 | +ARBAKRWA + R + TATGCTG (SEQ ID NO: 14960) |
| 97 | +AR + BAKRWAR + TATGCTG (SEQ ID NO: 14961) |
| 97 | +BAKRWA + R + TATGCTG (SEQ ID NO: 14962) |
| 97 | +BAKRWAR + T + ATGCTG (SEQ ID NO: 14963) |
| 97 | +BAKRWA + RT + ATGCTG (SEQ ID NO: 14964) |
| 97 | ACTGGCCAYCTTCCTGCTARYTTTARBAKRWARTATGCTG (SEQ ID NO: 14965) |
| 97 | TTTARBAKRWARTATGCTG (SEQ ID NO: 14966) |
| 97 | TARBAKRWARTATGCTG (SEQ ID NO: 14967) |
| 97 | ARBAKRWARTATGCTG (SEQ ID NO: 14968) |
| 97 | BAKRWARTATGCTG (SEQ ID NO: 14969) |
| 97 | TGTAYTRYTYTBACTGGCCAYCTYCCTGCTARYTTTARNAKRWARTATGC (SEQ ID NO: 14970) |
| 97 | ACTGGCCAYCTTCCTGCTARYTTTARBAKRWARTATGCTG + N (SEQ ID NO: 14971) |
| 97 | TTTARBAKRWARTATGCTG + N (SEQ ID NO: 14972) |
| 97 | TARBAKRWARTATGCTG + N (SEQ ID NO: 14973) |
| 97 | ARBAKRWARTATGCTG + N (SEQ ID NO: 14974) |
| 97 | BAKRWARTATGCTG + N (SEQ ID NO: 14975) |
| 97 | TGTAYTRYTYTBACTGGCCAYCTYCCTGCTARYTTTARNAKRWARTATGC + N (SEQ ID NO: 14976) |
| 118 | +CARCA + K + GCDGCYTTDACYGYABYRCTRGTRAARTTRSKRC (SEQ ID NO: 14977) |
| 118 | +CARCAK + GC + DGCYTTDACYGYABYRCTRGTRAARTTRSKRC (SEQ ID NO: 14978) |
| 118 | +CARCA + KGC + DGCYTTDACYGYABYRCTRGTRAARTTRSKRC (SEQ ID NO: 14979) |
| 118 | +K + GC + DGCYTTDACYGYABYRCTRGTRAARTTRSKRC (SEQ ID NO: 14980) |
| 118 | +KGC + D + GCYTTDACYGYABYRCTRGTRAARTTRSKRC (SEQ ID NO: 14981) |
| 118 | +K + GCD + GCYTTDACYGYABYRCTRGTRAARTTRSKRC (SEQ ID NO: 14982) |
| 118 | + GC + D + GCYTTDACYGYABYRCTRGTRAARTTRSKRC (SEQ ID NO: 14983) |
| 118 | +GCD + GC + YTTDACYGYABYRCTRGTRAARTTRSKRC (SEQ ID NO: 14984) |
| 118 | +GC + DGC + YTTDACYGYABYRCTRGTRAARTTRSKRC (SEQ ID NO: 14985) |
| 118 | +D + GC + YTTDACYGYABYRCTRGTRAARTTRSKRC (SEQ ID NO: 14986) |
| 118 | +DGC + YTTD + ACYGYABYRCTRGTRAARTTRSKRC (SEQ ID NO: 14987) |
| 118 | +D + GCYTTD + ACYGYABYRCTRGTRAARTTRSKRC (SEQ ID NO: 14988) |
| 118 | +GC + YTTD + ACYGYABYRCTRGTRAARTTRSKRC (SEQ ID NO: 14989) |
| 118 | +GCYTTD + ACYGYABYRCTRGT + RAARTTRSKRC (SEQ ID NO: 14990) |
| 118 | +GC + YTTDACYGYABYRCTRGT + RAARTTRSKRC (SEQ ID NO: 14991) |

| | |
|---|---|
| 118 | +YTTD + ACYGYABYRCTRGT + RAARTTRSKRC (SEQ ID NO: 14992) |
| 118 | +YTTDACYGYABYRCTRGT + R + AARTTRSKRC (SEQ ID NO: 14993) |
| 118 | +YTTD + ACYGYABYRCTRGTR + AARTTRSKRC (SEQ ID NO: 14994) |
| 118 | CARCAKGCDGCYTTDACYGYABYRCTRGTRAARTTRSKRC (SEQ ID NO: 14995) |
| 118 | KGCDGCYTTDACYGYABYRCTRGTRAARTTRSKRC (SEQ ID NO: 14996) |
| 118 | GCDGCYTTDACYGYABYRCTRGTRAARTTRSKRC (SEQ ID NO: 14997) |
| 118 | DGCYTTDACYGYABYRCTRGTRAARTTRSKRC (SEQ ID NO: 14998) |
| 118 | GCYTTDACYGYABYRCTRGTRAARTTRSKRC (SEQ ID NO: 14999) |
| 118 | YTTDACYGYABYRCTRGTRAARTTRSKRC (SEQ ID NO: 15000) |
| 118 | AYHYYBGCCCACCARCAKGCDGCYTTDACYGYRKYRCTRRTRAARTTGCT (SEQ ID NO: 15001) |
| 118 | CARCAKGCDGCYTTDACYGYABYRCTRGTRAARTTRSKRC + N (SEQ ID NO: 15002) |
| 118 | KGCDGCYTTDACYGYABYRCTRGTRAARTTRSKRC + N (SEQ ID NO: 15003) |
| 118 | GCDGCYTTDACYGYABYRCTRGTRAARTTRSKRC + N (SEQ ID NO: 15004) |
| 118 | DGCYTTDACYGYABYRCTRGTRAARTTRSKRC + N (SEQ ID NO: 15005) |
| 118 | GCYTTDACYGYABYRCTRGTRAARTTRSKRC + N (SEQ ID NO: 15006) |
| 118 | YTTDACYGYABYRCTRGTRAARTTRSKRC + N (SEQ ID NO: 15007) |
| 118 | AYHYYBGCCCACCARCAKGCDGCYTTDACYGYRKYRCTRRTRAARTTGCT + N (SEQ ID NO: 15008) |
| 121 | V + YYBG + CCCACCARCAKGCD + GCYTTDACYGYABYRCTRGTR (SEQ ID NO: 15009) |
| 121 | V + YYBGCCCACCARCAKGCD + G + CYTTDACYGYABYRCTRGTR (SEQ ID NO: 15010) |
| 121 | V + YYBG + CCCACCARCAKGCDG + CYTTDACYGYABYRCTRGTR (SEQ ID NO: 15011) |
| 121 | +CCCACCARCAKGCD + G + CYTTDACYGYABYRCTRGTR (SEQ ID NO: 15012) |
| 121 | +CCCACCARCAKGCDG + CY + TTDACYGYABYRCTRGTR (SEQ ID NO: 15013) |
| 121 | +CCCACCARCAKGCD + GCY + TTDACYGYABYRCTRGTR (SEQ ID NO: 15014) |
| 121 | +G + CY + TTDACYGYABYRCTRGTR (SEQ ID NO: 15015) |
| 121 | +GCY + T + TDACYGYABYRCTRGTR (SEQ ID NO: 15016) |
| 121 | +G + CYT + TDACYGYABYRCTRGTR (SEQ ID NO: 15017) |
| 121 | +CY + T + TDACYGYABYRCTRGTR (SEQ ID NO: 15018) |
| 121 | +CYT + TD + ACYGYABYRCTRGTR (SEQ ID NO: 15019) |
| 121 | +CY + TTD + ACYGYABYRCTRGTR (SEQ ID NO: 15020) |
| 121 | +T + TD + ACYGYABYRCTRGTR (SEQ ID NO: 15021) |
| 121 | +TTD + A + CYGYABYRCTRGTR (SEQ ID NO: 15022) |
| 121 | +T + TDA + CYGYABYRCTRGTR (SEQ ID NO: 15023) |
| 121 | +TD + A + CYGYABYRCTRGTR (SEQ ID NO: 15024) |
| 121 | +TDA + CY + GYABYRCTRGTR (SEQ ID NO: 15025) |
| 121 | +TD + ACY + GYABYRCTRGTR (SEQ ID NO: 15026) |
| 121 | VYYBGCCCACCARCAKGCDGCYTTDACYGYABYRCTRGTR (SEQ ID NO: 15027) |
| 121 | CCCACCARCAKGCDGCYTTDACYGYABYRCTRGTR (SEQ ID NO: 15028) |
| 121 | GCYTTDACYGYABYRCTRGTR (SEQ ID NO: 15029) |

TABLE 11-continued

| | |
|---|---|
| 121 | CYTTDACYGYABYRCTRGTR (SEQ ID NO: 15030) |
| 121 | TTDACYGYABYRCTRGTR (SEQ ID NO: 15031) |
| 121 | TDACYGYABYRCTRGTR (SEQ ID NO: 15032) |
| 121 | YTCYTGYBKRAYHYYBGCCCACCARCAKGCDGCYTTDACYGYRKYACTGGT (SEQ ID NO: 15033) |
| 121 | VYYBGCCCACCARCAKGCDGCYTTDACYGYABYRCTRGTR + N (SEQ ID NO: 15034) |
| 121 | CCCACCARCAKGCDGCYTTDACYGYABYRCTRGTR + N (SEQ ID NO: 15035) |
| 121 | GCYTTDACYGYABYRCTRGTR + N (SEQ ID NO: 15036) |
| 121 | CYTTDACYGYABYRCTRGTR + N (SEQ ID NO: 15037) |
| 121 | TTDACYGYABYRCTRGTR + N (SEQ ID NO: 15038) |
| 121 | TDACYGYABYRCTRGTR + N (SEQ ID NO: 15039) |
| 121 | YTCYTGYBKRAYHYYBGCCCACCARCAKGCDGCYTTDACYGYRKYACTGGT + N (SEQ ID NO: 15040) |
| 138 | Y + ACTA + CTC + CYTGRCTTTGGGGATTGTAGGGRATBCCAAAT (SEQ ID NO: 15041) |
| 138 | Y + ACTACTC + CY + TGRCTTTGGGGATTGTAGGGRATBCCAAAT (SEQ ID NO: 15042) |
| 138 | Y + ACTA + CTCCY + TGRCTTTGGGGATTGTAGGGRATBCCAAAT (SEQ ID NO: 15043) |
| 138 | +CTC + CY + TGRCTTTGGGGATTGTAGGGRATBCCAAAT (SEQ ID NO: 15044) |
| 138 | +CTCCY + T + GRCTTTGGGGATTGTAGGGRATBCCAAAT (SEQ ID NO: 15045) |
| 138 | +CTC + CYT + GRCTTTGGGGATTGTAGGGRATBCCAAAT (SEQ ID NO: 15046) |
| 138 | +CY + T + GRCTTTGGGGATTGTAGGGRATBCCAAAT (SEQ ID NO: 15047) |
| 138 | +CYT + GR + CTTTGGGGATTGTAGGGRATBCCAAAT (SEQ ID NO: 15048) |
| 138 | +CY + TGR + CTTTGGGGATTGTAGGGRATBCCAAAT (SEQ ID NO: 15049) |
| 138 | +T + GR + CTTTGGGGATTGTAGGGRATBCCAAAT (SEQ ID NO: 15050) |
| 138 | +TGR + C + TTTGGGGATTGTAGGGRATBCCAAAT (SEQ ID NO: 15051) |
| 138 | +T + GRC + TTTGGGGATTGTAGGGRATBCCAAAT (SEQ ID NO: 15052) |
| 138 | +GR + C + TTTGGGGATTGTAGGGRATBCCAAAT (SEQ ID NO: 15053) |
| 138 | +GRC + TT + TGGGGATTGTAGGGRATBCCAAAT (SEQ ID NO: 15054) |
| 138 | +GR + CTT + TGGGGATTGTAGGGRATBCCAAAT (SEQ ID NO: 15055) |
| 138 | +C + TT + TGGGGATTGTAGGGRATBCCAAAT (SEQ ID NO: 15056) |
| 138 | +CTT + T + GGGGATTGTAGGGRATBCCAAAT (SEQ ID NO: 15057) |
| 138 | +C + TTT + GGGGATTGTAGGGRATBCCAAAT (SEQ ID NO: 15058) |
| 138 | AC + TACT + CCY + TGRCTTTGGGGATTGTAGGGRATBCCAAATT (SEQ ID NO: 15059) |
| 138 | AC + TACTCCY + TG + RCTTTGGGGATTGTAGGGRATBCCAAATT (SEQ ID NO: 15060) |
| 138 | AC + TACT + CCYTG + RCTTTGGGGATTGTAGGGRATBCCAAATT (SEQ ID NO: 15061) |
| 138 | +CCY + TG + RCTTTGGGGATTGTAGGGRATBCCAAATT (SEQ ID NO: 15062) |
| 138 | +CCYTG + R + CTTTGGGGATTGTAGGGRATBCCAAATT (SEQ ID NO: 15063) |
| 138 | +CCY + TGR + CTTTGGGGATTGTAGGGRATBCCAAATT (SEQ ID NO: 15064) |
| 138 | +TG + R + CTTTGGGGATTGTAGGGRATBCCAAATT (SEQ ID NO: 15065) |
| 138 | +TGR + CT + TTGGGGATTGTAGGGRATBCCAAATT (SEQ ID NO: 15066) |

TABLE 11-continued

| | | |
|---|---|---|
| 138 | +TG + RCT + TTGGGGATTGTAGGGRATBCCAAATT (SEQ ID NO: 15067) | |
| 138 | +R + CT + TTGGGGATTGTAGGGRATBCCAAATT (SEQ ID NO: 15068) | |
| 138 | +RCT + T + TGGGGATTGTAGGGRATBCCAAATT (SEQ ID NO: 15069) | |
| 138 | +R + CTT + TGGGGATTGTAGGGRATBCCAAATT (SEQ ID NO: 15070) | |
| 138 | +CT + T + TGGGGATTGTAGGGRATBCCAAATT (SEQ ID NO: 15071) | |
| 138 | +CTT + TG + GGGATTGTAGGGRATBCCAAATT (SEQ ID NO: 15072) | |
| 138 | +CT + TTG + GGGATTGTAGGGRATBCCAAATT (SEQ ID NO: 15073) | |
| 138 | +T + TG + GGGGATTGTAGGGRATBCCAAATT (SEQ ID NO: 15074) | |
| 138 | +TTG + G + GGATTGTAGGGRATBCCAAATT (SEQ ID NO: 15075) | |
| 138 | +T + TGG + GGATTGTAGGGRATBCCAAATT (SEQ ID NO: 15076) | |
| 138 | YACTACTCCYTGRCTTTGGGGATTGTAGGGRATBCCAAAT (SEQ ID NO: 15077) | |
| 138 | CTCCYTGRCTTTGGGGATTGTAGGGRATBCCAAAT (SEQ ID NO: 15078) | |
| 138 | CYTGRCTTTGGGGATTGTAGGGRATBCCAAAT (SEQ ID NO: 15079) | |
| 138 | TGRCTTTGGGGATTGTAGGGRATBCCAAAT (SEQ ID NO: 15080) | |
| 138 | GRCTTTGGGGATTGTAGGGRATBCCAAAT (SEQ ID NO: 15081) | |
| 138 | CTTTGGGGATTGTAGGGRATBCCAAAT (SEQ ID NO: 15082) | |
| 138 | ACTACTCCYTGRCTTTGGGGATTGTAGGGRATBCCAAATT (SEQ ID NO: 15083) | |
| 138 | CCYTGRCTTTGGGGATTGTAGGGRATBCCAAATT (SEQ ID NO: 15084) | |
| 138 | TGRCTTTGGGGATTGTAGGGRATBCCAAATT (SEQ ID NO: 15085) | |
| 138 | RCTTTGGGGATTGTAGGGRATBCCAAATT (SEQ ID NO: 15086) | |
| 138 | CTTTGGGGATTGTAGGGRATBCCAAATT (SEQ ID NO: 15087) | |
| 138 | TTGGGGATTGTAGGGRATBCCAAATT (SEQ ID NO: 15088) | |
| 138 | ATTCATRGAYTCYACTACTCCYTGRCTTTGRGGATTGTAGGGRATTCCAAA (SEQ ID NO: 15089) | |
| 138 | YACTACTCCYTGRCTTTGGGGATTGTAGGGRATBCCAAAT + N (SEQ ID NO: 15090) | |
| 138 | CTCCYTGRCTTTGGGGATTGTAGGGRATBCCAAAT + N (SEQ ID NO: 15091) | |
| 138 | CYTGRCTTTGGGGATTGTAGGGRATBCCAAAT + N (SEQ ID NO: 15092) | |
| 138 | TGRCTTTGGGGATTGTAGGGRATBCCAAAT + N (SEQ ID NO: 15093) | |
| 138 | GRCTTTGGGGATTGTAGGGRATBCCAAAT + N (SEQ ID NO: 15094) | |
| 138 | CTTTGGGGATTGTAGGGRATBCCAAAT + N (SEQ ID NO: 15095) | |
| 138 | ACTACTCCYTGRCTTTGGGGATTGTAGGGRATBCCAAATT + N (SEQ ID NO: 15096) | |
| 138 | CCYTGRCTTTGGGGATTGTAGGGRATBCCAAATT + N (SEQ ID NO: 15097) | |
| 138 | TGRCTTTGGGGATTGTAGGGRATBCCAAATT + N (SEQ ID NO: 15098) | |
| 138 | RCTTTGGGGATTGTAGGGRATBCCAAATT + N (SEQ ID NO: 15099) | |
| 138 | CTTTGGGGATTGTAGGGRATBCCAAATT + N (SEQ ID NO: 15100) | |
| 138 | TTGGGGATTGTAGGGRATBCCAAATT + N (SEQ ID NO: 15101) | |
| 138 | ATTCATRGAYTCYACTACTCCYTGRCTTTGRGGATTGTAGGGRATTCCAAA + N (SEQ ID NO: 15102) | |
| 140 | RG + AY + T + CYACTACTCCYTGRCTTTGGGGATTGTAGGGRATB (SEQ ID NO: 15103) | |

TABLE 11-continued

140 RG + AYT + CY + ACTACTCCYTGRCTTTGGGGATTGTAGGGRATB (SEQ ID NO: 15104)

140 RG + AY + TCY + ACTACTCCYTGRCTTTGGGGATTGTAGGGRATB (SEQ ID NO: 15105)

140 +T + CY + ACTACTCCYTGRCTTTGGGGATTGTAGGGRATB (SEQ ID NO: 15106)

140 +TCY + A + CTACTCCYTGRCTTTGGGGATTGTAGGGRATB (SEQ ID NO: 15107)

140 +T + CYA + CTACTCCYTGRCTTTGGGGATTGTAGGGRATB (SEQ ID NO: 15108)

140 +CY + A + CTACTCCYTGRCTTTGGGGATTGTAGGGRATB (SEQ ID NO: 15109)

140 +CYA + CT + ACTCCYTGRCTTTGGGGATTGTAGGGRATB (SEQ ID NO: 15110)

140 +CY + ACT + ACTCCYTGRCTTTGGGGATTGTAGGGRATB (SEQ ID NO: 15111)

140 +A + CT + ACTCCYTGRCTTTGGGGATTGTAGGGRATB (SEQ ID NO: 15112)

140 +ACT + A + CTCCYTGRCTTTGGGGATTGTAGGGRATB (SEQ ID NO: 15113)

140 +A + CTA + CTCCYTGRCTTTGGGGATTGTAGGGRATB (SEQ ID NO: 15114)

140 +CT + A + CTCCYTGRCTTTGGGGATTGTAGGGRATB (SEQ ID NO: 15115)

140 +CTA + CT + CCYTGRCTTTGGGGATTGTAGGGRATB (SEQ ID NO: 15116)

140 +CT + ACT + CCYTGRCTTTGGGGATTGTAGGGRATB (SEQ ID NO: 15117)

140 +A + CT + CCYTGRCTTTGGGGATTGTAGGGRATB (SEQ ID NO: 15118)

140 +ACT + C + CYTGRCTTTGGGGATTGTAGGGRATB (SEQ ID NO: 15119)

140 +A + CTC + CYTGRCTTTGGGGATTGTAGGGRATB (SEQ ID NO: 15120)

140 +GAY + TC + YACTACTCCYTGRCTTTGGGGATTGTAGGGRATBC (SEQ ID NO: 15121)

140 GAYTC + Y + AC + TACTCCYTGRCTTTGGGGATTGTAGGGRATBC (SEQ ID NO: 15122)

140 GAY + TC + YAC + TACTCCYTGRCTTTGGGGATTGTAGGGRATBC (SEQ ID NO: 15123)

140 +TC + Y + ACTACTCCYTGRCTTTGGGGATTGTAGGGRATBC (SEQ ID NO: 15124)

140 +TCY + AC + TACTCCYTGRCTTTGGGGATTGTAGGGRATBC (SEQ ID NO: 15125)

140 +TC + YAC + TACTCCYTGRCTTTGGGGATTGTAGGGRATBC (SEQ ID NO: 15126)

140 +Y + AC + TACTCCYTGRCTTTGGGGATTGTAGGGRATBC (SEQ ID NO: 15127)

140 +YAC + T + ACTCCYTGRCTTTGGGGATTGTAGGGRATBC (SEQ ID NO: 15128)

140 +Y + ACT + ACTCCYTGRCTTTGGGGATTGTAGGGRATBC (SEQ ID NO: 15129)

140 +AC + T + ACTCCYTGRCTTTGGGGATTGTAGGGRATBC (SEQ ID NO: 15130)

140 +ACT + AC + TCCYTGRCTTTGGGGATTGTAGGGRATBC (SEQ ID NO: 15131)

140 +AC + TAC + TCCYTGRCTTTGGGGATTGTAGGGRATBC (SEQ ID NO: 15132)

140 +T + AC + TCCYTGRCTTTGGGGATTGTAGGGRATBC (SEQ ID NO: 15133)

140 +TAC + T + CCYTGRCTTTGGGGATTGTAGGGRATBC (SEQ ID NO: 15134)

140 +T + ACT + CCYTGRCTTTGGGGATTGTAGGGRATBC (SEQ ID NO: 15135)

140 +AC + T + CCYTGRCTTTGGGGATTGTAGGGRATBC (SEQ ID NO: 15136)

140 +ACT + CC + YTGRCTTTGGGGATTGTAGGGRATBC (SEQ ID NO: 15137)

140 +AC + TCC + YTGRCTTTGGGGATTGTAGGGRATBC (SEQ ID NO: 15138)

TABLE 11-continued

140 RGAYTCYACTACTCCYTGRCTTTGGGGATTGTAGGGRATB (SEQ ID
    NO: 15139)

140 TCYACTACTCCYTGRCTTTGGGGATTGTAGGGRATB (SEQ ID NO: 15140)

140 CYACTACTCCYTGRCTTTGGGGATTGTAGGGRATB (SEQ ID NO: 15141)

140 ACTACTCCYTGRCTTTGGGGATTGTAGGGRATB (SEQ ID NO: 15142)

140 CTACTCCYTGRCTTTGGGGATTGTAGGGRATB (SEQ ID NO: 15143)

140 ACTCCYTGRCTTTGGGGATTGTAGGGRATB (SEQ ID NO: 15144)

140 GAYTCYACTACTCCYTGRCTTTGGGGATTGTAGGGRATBC (SEQ ID NO: 15145)

140 TCYACTACTCCYTGRCTTTGGGGATTGTAGGGRATBC (SEQ ID NO: 15146)

140 YACTACTCCYTGRCTTTGGGGATTGTAGGGRATBC (SEQ ID NO: 15147)

140 ACTACTCCYTGRCTTTGGGGATTGTAGGGRATBC (SEQ ID NO: 15148)

140 TACTCCYTGRCTTTGGGGATTGTAGGGRATBC (SEQ ID NO: 15149)

140 ACTCCYTGRCTTTGGGGATTGTAGGGRATBC (SEQ ID NO: 15150)

140 AYTCHTTATTCATRGAYTCYACTACTCCYTGRCTTTGRGGATTGTAGGGAAT
    (SEQ ID NO: 15151)

140 RGAYTCYACTACTCCYTGRCTTTGGGGATTGTAGGGRATB + N (SEQ ID NO: 15152)

140 TCYACTACTCCYTGRCTTTGGGGATTGTAGGGRATB + N (SEQ ID NO: 15153)

140 CYACTACTCCYTGRCTTTGGGGATTGTAGGGRATB + N (SEQ ID NO: 15154)

140 ACTACTCCYTGRCTTTGGGGATTGTAGGGRATB + N (SEQ ID NO: 15155)

140 CTACTCCYTGRCTTTGGGGATTGTAGGGRATB + N (SEQ ID NO: 15156)

140 ACTCCYTGRCTTTGGGGATTGTAGGGRATB + N (SEQ ID NO: 15157)

140 GAYTCYACTACTCCYTGRCTTTGGGGATTGTAGGGRATBC + N (SEQ ID NO: 15158)

140 TCYACTACTCCYTGRCTTTGGGGATTGTAGGGRATBC + N (SEQ ID NO: 15159)

140 YACTACTCCYTGRCTTTGGGGATTGTAGGGRATBC + N (SEQ ID NO: 15160)

140 ACTACTCCYTGRCTTTGGGGATTGTAGGGRATBC + N (SEQ ID NO: 15161)

140 TACTCCYTGRCTTTGGGGATTGTAGGGRATBC + N (SEQ ID NO: 15162)

140 ACTCCYTGRCTTTGGGGATTGTAGGGRATBC + N (SEQ ID NO: 15163)

140 AYTCHTTATTCATRGAYTCYACTACTCCYTGRCTTTGRGGATTGTAGGGAAT + N
    (SEQ ID NO: 15164)

143 Y + T + TA + TTCATRGAYTCYACTACTCCYTGRCTTTGGGGATTG (SEQ ID NO: 15165)

143 Y + TTA + T + TCATRGAYTCYACTACTCCYTGRCTTTGGGGATTG (SEQ ID NO: 15166)

143 Y + T + TAT + TCATRGAYTCYACTACTCCYTGRCTTTGGGGATTG (SEQ ID
    NO: 15167)

143 +TA + T + TCATRGAYTCYACTACTCCYTGRCTTTGGGGATTG (SEQ ID
    NO: 15168)

143 +TAT + TC + ATRGAYTCYACTACTCCYTGRCTTTGGGGATTG (SEQ ID
    NO: 15169)

143 + A + TTC + ATRGAYTCYACTACTCCYTGRCTTTGGGGATTG (SEQ ID
    NO: 15170)

143 +T + TC + ATRGAYTCYACTACTCCYTGRCTTTGGGGATTG (SEQ ID NO: 15171)

143 +TTC + A + TRGAYTCYACTACTCCYTGRCTTTGGGGATTG (SEQ ID NO: 15172)

143 +T + TCA + TRGAYTCYACTACTCCYTGRCTTTGGGGATTG (SEQ ID NO: 15173)

143 +TC + A + TRGAYTCYACTACTCCYTGRCTTTGGGGATTG (SEQ ID NO: 15174)

| | | |
|---|---|---|
| 143 | +TCA + TR + | GAYTCYACTACTCCYTGRCTTTGGGGATTG (SEQ ID NO: 15175) |
| 143 | +TC + ATR + | GAYTCYACTACTCCYTGRCTTTGGGGATTG (SEQ ID NO: 15176) |
| 143 | +A + TR + | GAYTCYACTACTCCYTGRCTTTGGGGATTG (SEQ ID NO: 15177) |
| 143 | +ATR + G + | AYTCYACTACTCCYTGRCTTTGGGGATTG (SEQ ID NO: 15178) |
| 143 | +A + TRG + | AYTCYACTACTCCYTGRCTTTGGGGATTG (SEQ ID NO: 15179) |
| 143 | +TR + G + | AYTCYACTACTCCYTGRCTTTGGGGATTG (SEQ ID NO: 15180) |
| 143 | +TRG + AY + | TCYACTACTCCYTGRCTTTGGGGATTG (SEQ ID NO: 15181) |
| 143 | +TR + GAY + | TCYACTACTCCYTGRCTTTGGGGATTG (SEQ ID NO: 15182) |
| 143 | +TT + A + | TTCATRGAYTCYACTACTCCYTGRCTTTGGGGATTGT (SEQ ID NO: 15183) |
| 143 | TTA + TT + C + | ATRGAYTCYACTACTCCYTGRCTTTGGGGATTGT (SEQ ID NO: 15184) |
| 143 | TT + A + TTC + | ATRGAYTCYACTACTCCYTGRCTTTGGGGATTGT (SEQ ID NO: 15185) |
| 143 | +A + TT + | CATRGAYTCYACTACTCCYTGRCTTTGGGGATTGT (SEQ ID NO: 15186) |
| 143 | +ATT + C + | ATRGAYTCYACTACTCCYTGRCTTTGGGGATTGT (SEQ ID NO: 15187) |
| 143 | +A + TTC + | ATRGAYTCYACTACTCCYTGRCTTTGGGGATTGT (SEQ ID NO: 15188) |
| 143 | +TT + C + | ATRGAYTCYACTACTCCYTGRCTTTGGGGATTGT (SEQ ID NO: 15189) |
| 143 | +TTC + AT + | RGAYTCYACTACTCCYTGRCTTTGGGGATTGT (SEQ ID NO: 15190) |
| 143 | +TT + CAT + | RGAYTCYACTACTCCYTGRCTTTGGGGATTGT (SEQ ID NO: 15191) |
| 143 | +C + AT + | RGAYTCYACTACTCCYTGRCTTTGGGGATTGT (SEQ ID NO: 15192) |
| 143 | +CAT + R + | GAYTCYACTACTCCYTGRCTTTGGGGATTGT (SEQ ID NO: 15193) |
| 143 | +C + ATR + | GAYTCYACTACTCCYTGRCTTTGGGGATTGT (SEQ ID NO: 15194) |
| 143 | +AT + R + | GAYTCYACTACTCCYTGRCTTTGGGGATTGT (SEQ ID NO: 15195) |
| 143 | +ATR + GA + | YTCYACTACTCCYTGRCTTTGGGGATTGT (SEQ ID NO: 15196) |
| 143 | +AT + RGA + | YTCYACTACTCCYTGRCTTTGGGGATTGT (SEQ ID NO: 15197) |
| 143 | +R + GA + | YTCYACTACTCCYTGRCTTTGGGGATTGT (SEQ ID NO: 15198) |
| 143 | +RGA + Y + | TCYACTACTCCYTGRCTTTGGGGATTGT (SEQ ID NO: 15199) |
| 143 | +R + GAY + | TCYACTACTCCYTGRCTTTGGGGATTGT (SEQ ID NO: 15200) |
| 143 | YTTATTCATRGAYTCYACTACTCCYTGRCTTTGGGGATTG (SEQ ID NO: 15201) | |
| 143 | TATTCATRGAYTCYACTACTCCYTGRCTTTGGGGATTG (SEQ ID NO: 15202) | |
| 143 | TTCATRGAYTCYACTACTCCYTGRCTTTGGGGATTG (SEQ ID NO: 15203) | |
| 143 | TCATRGAYTCYACTACTCCYTGRCTTTGGGGATTG (SEQ ID NO: 15204) | |
| 143 | ATRGAYTCYACTACTCCYTGRCTTTGGGGATTG (SEQ ID NO: 15205) | |
| 143 | TRGAYTCYACTACTCCYTGRCTTTGGGGATTG (SEQ ID NO: 15206) | |
| 143 | TTATTCATRGAYTCYACTACTCCYTGRCTTTGGGGATTGT (SEQ ID NO: 15207) | |
| 143 | ATTCATRGAYTCYACTACTCCYTGRCTTTGGGGATTGT (SEQ ID NO: 15208) | |
| 143 | TTCATRGAYTCYACTACTCCYTGRCTTTGGGGATTGT (SEQ ID NO: 15209) | |
| 143 | CATRGAYTCYACTACTCCYTGRCTTTGGGGATTGT (SEQ ID NO: 15210) | |

TABLE 11-continued

| | |
|---|---|
| 143 | ATRGAYTCYACTACTCCYTGRCTTTGGGGATTGT (SEQ ID NO: 15211) |
| 143 | RGAYTCYACTACTCCYTGRCTTTGGGGATTGT (SEQ ID NO: 15212) |
| 143 | YTTCTTTAAYTCHTTATTCATRGAYTCYACTACTCCYTGRCTTTGGGGATT (SEQ ID NO: 15213) |
| 143 | YTTATTCATRGAYTCYACTACTCCYTGRCTTTGGGGATTG + N (SEQ ID NO: 15214) |
| 143 | TATTCATRGAYTCYACTACTCCYTGRCTTTGGGGATTG + N (SEQ ID NO: 15215) |
| 143 | TTCATRGAYTCYACTACTCCYTGRCTTTGGGGATTG + N (SEQ ID NO: 15216) |
| 143 | TCATRGAYTCYACTACTCCYTGRCTTTGGGGATTG + N (SEQ ID NO: 15217) |
| 143 | ATRGAYTCYACTACTCCYTGRCTTTGGGGATTG + N (SEQ ID NO: 15218) |
| 143 | TRGAYTCYACTACTCCYTGRCTTTGGGGATTG + N (SEQ ID NO: 15219) |
| 143 | TTATTCATRGAYTCYACTACTCCYTGRCTTTGGGGATTGT + N (SEQ ID NO: 15220) |
| 143 | ATTCATRGAYTCYACTACTCCYTGRCTTTGGGGATTGT + N (SEQ ID NO: 15221) |
| 143 | TTCATRGAYTCYACTACTCCYTGRCTTTGGGGATTGT + N (SEQ ID NO: 15222) |
| 143 | CATRGAYTCYACTACTCCYTGRCTTTGGGGATTGT + N (SEQ ID NO: 15223) |
| 143 | ATRGAYTCYACTACTCCYTGRCTTTGGGGATTGT + N (SEQ ID NO: 15224) |
| 143 | RGAYTCYACTACTCCYTGRCTTTGGGGATTGT + N (SEQ ID NO: 15225) |
| 143 | YTTCTTTAAYTCHTTATTCATRGAYTCYACTACTCCYTGRCTTTGGGGATT + N (SEQ ID NO: 15226) |
| 145 | +AA + Y + TCYTTATTCATRGAYTCYACTACTCCYTGRCTTTGGG (SEQ ID NO: 15227) |
| 145 | +AAY + TC + YTTATTCATRGAYTCYACTACTCCYTGRCTTTGGG (SEQ ID NO: 15228) |
| 145 | +AA + YTC + YTTATTCATRGAYTCYACTACTCCYTGRCTTTGGG (SEQ ID NO: 15229) |
| 145 | +Y + TC + YTTATTCATRGAYTCYACTACTCCYTGRCTTTGGG (SEQ ID NO: 15230) |
| 145 | +YTC + Y + TTATTCATRGAYTCYACTACTCCYTGRCTTTGGG (SEQ ID NO: 15231) |
| 145 | +Y + TCY + TTATTCATRGAYTCYACTACTCCYTGRCTTTGGG (SEQ ID NO: 15232) |
| 145 | +TC + Y + TTATTCATRGAYTCYACTACTCCYTGRCTTTGGG (SEQ ID NO: 15233) |
| 145 | +TCY + TT + ATTCATRGAYTCYACTACTCCYTGRCTTTGGG (SEQ ID NO: 15234) |
| 145 | +TC + YTT + ATTCATRGAYTCYACTACTCCYTGRCTTTGGG (SEQ ID NO: 15235) |
| 145 | +Y + TT + ATTCATRGAYTCYACTACTCCYTGRCTTTGGG (SEQ ID NO: 15236) |
| 145 | +YTT + A + TTCATRGAYTCYACTACTCCYTGRCTTTGGG (SEQ ID NO: 15237) |
| 145 | +Y + TTA + TTCATRGAYTCYACTACTCCYTGRCTTTGGG (SEQ ID NO: 15238) |
| 145 | +TT + A + TTCATRGAYTCYACTACTCCYTGRCTTTGGG (SEQ ID NO: 15239) |
| 145 | +TTA + TT + CATRGAYTCYACTACTCCYTGRCTTTGGG (SEQ ID NO: 15240) |
| 145 | +TT + ATT + CATRGAYTCYACTACTCCYTGRCTTTGGG (SEQ ID NO: 15241) |
| 145 | +A + TT + CATRGAYTCYACTACTCCYTGRCTTTGGG (SEQ ID NO: 15242) |
| 145 | +ATT + C + ATRGAYTCYACTACTCCYTGRCTTTGGG (SEQ ID NO: 15243) |
| 145 | +A + TTC + ATRGAYTCYACTACTCCYTGRCTTTGGG (SEQ ID NO: 15244) |

TABLE 11-continued

| | |
|---|---|
| 145 | AAYTCYTTATTCATRGAYTCYACTACTCCYTGRCTTTGGG (SEQ ID NO: 15245) |
| 145 | YTCYTTATTCATRGAYTCYACTACTCCYTGRCTTTGGG (SEQ ID NO: 15246) |
| 145 | TCYTTATTCATRGAYTCYACTACTCCYTGRCTTTGGG (SEQ ID NO: 15247) |
| 145 | YTTATTCATRGAYTCYACTACTCCYTGRCTTTGGG (SEQ ID NO: 15248) |
| 145 | TTATTCATRGAYTCYACTACTCCYTGRCTTTGGG (SEQ ID NO: 15249) |
| 145 | ATTCATRGAYTCYACTACTCCYTGRCTTTGGG (SEQ ID NO: 15250) |
| 145 | TATRATYTTCTTTAAYTCHTTATTCATRGAYTCYACTACTCCYTGACTTTG (SEQ ID NO: 15251) |
| 145 | AAYTCYTTATTCATRGAYTCYACTACTCCYTGRCTTTGGG + N (SEQ ID NO: 15252) |
| 145 | YTCYTTATTCATRGAYTCYACTACTCCYTGRCTTTGGG + N (SEQ ID NO: 15253) |
| 145 | TCYTTATTCATRGAYTCYACTACTCCYTGRCTTTGGG + N (SEQ ID NO: 15254) |
| 145 | YTTATTCATRGAYTCYACTACTCCYTGRCTTTGGG + N (SEQ ID NO: 15255) |
| 145 | TTATTCATRGAYTCYACTACTCCYTGRCTTTGGG + N (SEQ ID NO: 15256) |
| 145 | ATTCATRGAYTCYACTACTCCYTGRCTTTGGG + N (SEQ ID NO: 15257) |
| 145 | TATRATYTTCTTTAAYTCHTTATTCATRGAYTCYACTACTCCYTGACTTTG + N (SEQ ID NO: 15258) |
| 146 | C + T + TT + AAYTCYTTATTCATRGAYTCYACTACTCCYTGRCTT (SEQ ID NO: 15259) |
| 146 | C + TTT + A + AYTCYTTATTCATRGAYTCYACTACTCCYTGRCTT (SEQ ID NO: 15260) |
| 146 | C + T + TTA + AYTCYTTATTCATRGAYTCYACTACTCCYTGRCTT (SEQ ID NO: 15261) |
| 146 | +TT + A + AYTCYTTATTCATRGAYTCYACTACTCCYTGRCTT (SEQ ID NO: 1562) |
| 146 | +TTA + AY + TCYTTATTCATRGAYTCYACTACTCCYTGRCTT (SEQ ID NO: 15262) |
| 146 | +TT + AAY + TCYTTATTCATRGAYTCYACTACTCCYTGRCTT (SEQ ID NO: 15263) NO: 15264) |
| 146 | +A + AY + TCYTTATTCATRGAYTCYACTACTCCYTGRCTT (SEQ ID NO: 15265) |
| 146 | +AAY + T + CYTTATTCATRGAYTCYACTACTCCYTGRCTT (SEQ ID NO: 15266) |
| 146 | +A + AYT + CYTTATTCATRGAYTCYACTACTCCYTGRCTT (SEQ ID NO: 15267) |
| 146 | +AY + T + CYTTATTCATRGAYTCYACTACTCCYTGRCTT (SEQ ID NO: 15268) |
| 146 | +AYT + CY + TTATTCATRGAYTCYACTACTCCYTGRCTT (SEQ ID NO: 15269) |
| 146 | +AY + TCY + TTATTCATRGAYTCYACTACTCCYTGRCTT (SEQ ID NO: 15270) |
| 146 | +T + CY + TTATTCATRGAYTCYACTACTCCYTGRCTT (SEQ ID NO: 15271) |
| 146 | +TCY + TTATTCA + TRGAYTCYACTACTCCYTGRCTT (SEQ ID NO: 15272) |
| 146 | +T + CYTTATTCA + TRGAYTCYACTACTCCYTGRCTT (SEQ ID NO: 15273) |
| 146 | +CY + TTATTCA + TRGAYTCYACTACTCCYTGRCTT (SEQ ID NO: 15274) |
| 146 | +CYTTATTCA + TRGAYTCYA + CTACTCCYTGRCTT (SEQ ID NO: 15275) |
| 146 | +CY + TTATTCATRGAYTCYA + CTACTCCYTGRCTT (SEQ ID NO: 15276) |
| 146 | CTTTAAYTCYTTATTCATRGAYTCYACTACTCCYTGRCTT (SEQ ID NO: 15277) |
| 146 | TTAAYTCYTTATTCATRGAYTCYACTACTCCYTGRCTT (SEQ ID NO: 15278) |
| 146 | AAYTCYTTATTCATRGAYTCYACTACTCCYTGRCTT (SEQ ID NO: 15279) |

TABLE 11-continued

| | |
|---|---|
| 146 | AYTCYTTATTCATRGAYTCYACTACTCCYTGRCTT (SEQ ID NO: 15280) |
| 146 | TCYTTATTCATRGAYTCYACTACTCCYTGRCTT (SEQ ID NO: 15281) |
| 146 | CYTTATTCATRGAYTCYACTACTCCYTGRCTT (SEQ ID NO: 15282) |
| 146 | YYCTATRATYTTCTTTAAYTCHTTATTCATRGAYTCYACTACTCCTTGACT (SEQ ID NO: 15283) |
| 146 | CTTTAAYTCYTTATTCATRGAYTCYACTACTCCYTGRCTT + N (SEQ ID NO: 15284) |
| 146 | TTAAYTCYTTATTCATRGAYTCYACTACTCCYTGRCTT + N (SEQ ID NO: 15285) |
| 146 | AAYTCYTTATTCATRGAYTCYACTACTCCYTGRCTT + N (SEQ ID NO: 15286) |
| 146 | AYTCYTTATTCATRGAYTCYACTACTCCYTGRCTT + N (SEQ ID NO: 15287) |
| 146 | TCYTTATTCATRGAYTCYACTACTCCYTGRCTT + N (SEQ ID NO: 15288) |
| 146 | CYTTATTCATRGAYTCYACTACTCCYTGRCTT + N (SEQ ID NO: 15289) |
| 146 | YYCTATRATYTTCTTTAAYTCHTTATTCATRGAYTCYACTACTCCTTGACT + N (SEQ ID NO: 15290) |
| 147 | + TT + C + TTTAAYTCYTTATTCATRGAYTCYACTACTCCYTGRC (SEQ ID NO: 15291) |
| 147 | TTC + TT + T + AAYTCYTTATTCATRGAYTCYACTACTCCYTGRC (SEQ ID NO: 15292) |
| 147 | TT + C + TTT + AAYTCYTTATTCATRGAYTCYACTACTCCYTGRC (SEQ ID NO: 15293) |
| 147 | +C + TT + TAAYTCYTTATTCATRGAYTCYACTACTCCYTGRC (SEQ ID NO: 15294) |
| 147 | +CTT + T + AAYTCYTTATTCATRGAYTCYACTACTCCYTGRC (SEQ ID NO: 15295) |
| 147 | +C + TTT + AAYTCYTTATTCATRGAYTCYACTACTCCYTGRC (SEQ ID NO: 15296) |
| 147 | +TT + T + AAYTCYTTATTCATRGAYTCYACTACTCCYTGRC (SEQ ID NO: 15297) |
| 147 | +TTT + AA + YTCYTTATTCATRGAYTCYACTACTCCYTGRC (SEQ ID NO: 15298) |
| 147 | +TT + TAA + YTCYTTATTCATRGAYTCYACTACTCCYTGRC (SEQ ID NO: 15299) |
| 147 | +T + AA + YTCYTTATTCATRGAYTCYACTACTCCYTGRC (SEQ ID NO: 15300) |
| 147 | +TAA + YTCYTTA + TTCATRGAYTCYACTACTCCYTGRC (SEQ ID NO: 15301) |
| 147 | +T + AAYTCYTTA + TTCATRGAYTCYACTACTCCYTGRC (SEQ ID NO: 15302) |
| 147 | +AA + YTCYTTA + TTCATRGAYTCYACTACTCCYTGRC (SEQ ID NO: 15303) |
| 147 | +AAYTCYTTA + TTCATRGAY + TCYACTACTCCYTGRC (SEQ ID NO: 15304) |
| 147 | +AA + YTCYTTATTCATRGAY + TCYACTACTCCYTGRC (SEQ ID NO: 15305) |
| 147 | +YTCYTTA + TTCATRGAY + TCYACTACTCCYTGRC (SEQ ID NO: 15306) |
| 147 | +YTCYTTATTCATRGAY + TCYACTACT + CCYTGRC (SEQ ID NO: 15307) |
| 147 | +YTCYTTA + TTCATRGAYTCYACTACT + CCYTGRC (SEQ ID NO: 15308) |
| 147 | TTCTTTAAYTCYTTATTCATRGAYTCYACTACTCCYTGRC (SEQ ID NO: 15309) |
| 147 | CTTTAAYTCYTTATTCATRGAYTCYACTACTCCYTGRC (SEQ ID NO: 15310) |
| 147 | TTTAAYTCYTTATTCATRGAYTCYACTACTCCYTGRC (SEQ ID NO: 15311) |
| 147 | TAAYTCYTTATTCATRGAYTCYACTACTCCYTGRC (SEQ ID NO: 15312) |
| 147 | AAYTCYTTATTCATRGAYTCYACTACTCCYTGRC (SEQ ID NO: 15313) |
| 147 | YTCYTTATTCATRGAYTCYACTACTCCYTGRC (SEQ ID NO: 15314) |
| 147 | TGYYCTATRATYTTCTTTAAYTCHTTATTCATRGAYTCYACTACTCCTTG (SEQ ID NO: 15315) |
| 147 | TTCTTTAAYTCYTTATTCATRGAYTCYACTACTCCYTGRC + N (SEQ ID NO: 15316) |

TABLE 11-continued

| | |
|---|---|
| 147 | CTTTAAYTCYTTATTCATRGAYTCYACTACTCCYTGRC + N (SEQ ID NO: 15317) |
| 147 | TTTAAYTCYTTATTCATRGAYTCYACTACTCCYTGRC + N (SEQ ID NO: 15318) |
| 147 | TAAYTCYTTATTCATRGAYTCYACTACTCCYTGRC + N (SEQ ID NO: 15319) |
| 147 | AAYTCYTTATTCATRGAYTCYACTACTCCYTGRC + N (SEQ ID NO: 15320) |
| 147 | YTCYTTATTCATRGAYTCYACTACTCCYTGRC + N (SEQ ID NO: 15321) |
| 147 | TGYYCTATRATYTTCTTTAAYTCHTTATTCATRGAYTCYACTACTCCTTG + N (SEQ ID NO: 15322) |
| 148 | +T + RA + TTTTCTTTAAYTCYTTATTCATRGAYTCYACTACTCC (SEQ ID NO: 15323) |
| 148 | TRA + TTTTCTT + TAAYTCYTT + ATTCATRGAYTCYACTACTCC (SEQ ID NO: 15324) |
| 148 | T + RA + TTTTCTTTAAYTCYTT + ATTCATRGAYTCYACTACTCC (SEQ ID NO: 15325) |
| 148 | +RA + TTTTCTT + TAAYTCYTTATTCATRGAYTCYACTACTCC (SEQ ID NO: 15326) |
| 148 | +RATTTTCTT + TAAYTCYTT + ATTCATRGAYTCYACTACTCC (SEQ ID NO: 15327) |
| 148 | +RA + TTTTCTTTAAYTCYTT + ATTCATRGAYTCYACTACTCC (SEQ ID NO: 15328) |
| 148 | +TTTTCTT + TAAYTCYTT + ATTCATRGAYTCYACTACTCC (SEQ ID NO: 15329) |
| 148 | +TTTTCTTTAAYTCYTT + ATTCATRGA + YTCYACTACTCC (SEQ ID NO: 15330) |
| 148 | +TTTTCTT + TAAYTCYTTATTCATRGA + YTCYACTACTCC (SEQ ID NO: 15331) |
| 148 | +TAAYTCYTT + ATTCATRGA + YTCYACTACTCC (SEQ ID NO: 15332) |
| 148 | +TAAYTCYTTATTCATRGA + YT + CYACTACTCC (SEQ ID NO: 15333) |
| 148 | +TAAYTCYTT + ATTCATRGAYT + CYACTACTCC (SEQ ID NO: 15334) |
| 148 | +ATTCATRGA + YT + CYACTACTCC (SEQ ID NO: 15335) |
| 148 | +ATTCATRGAYT + CYACTAC + TCC (SEQ ID NO: 15336) |
| 148 | +ATTCATRGA + YTCYACTAC + TCC (SEQ ID NO: 15337) |
| 148 | +AT + T + TTCTTTAAYTCYTTATTCATRGAYTCYACTACTCCYT (SEQ ID NO: 15338) |
| 148 | +ATT + TT + CTTTAAYTCYTTATTCATRGAYTCYACTACTCCYT (SEQ ID NO: 15339) |
| 148 | +AT + TTT + CTTTAAYTCYTTATTCATRGAYTCYACTACTCCYT (SEQ ID NO: 15340) |
| 148 | +T + TT + CTTTAAYTCYTTATTCATRGAYTCYACTACTCCYT (SEQ ID NO: 15341) |
| 148 | +TTT + CTTTAAY + TCYTTATTCATRGAYTCYACTACTCCYT (SEQ ID NO: 15342) |
| 148 | +T + TTCTTTAAY + TCYTTATTCATRGAYTCYACTACTCCYT (SEQ ID NO: 15343) |
| 148 | +TT + CTTTAAY + TCYTTATTCATRGAYTCYACTACTCCYT (SEQ ID NO: 15344) |
| 148 | +TTCTTTAAY + TCYTTATTC + ATRGAYTCYACTACTCCYT (SEQ ID NO: 15345) |
| 148 | +TT + CTTTAAYTCYTTATTC + ATRGAYTCYACTACTCCYT (SEQ ID NO: 15346) |
| 148 | +CTTTAAY + TCYTTATTC + ATRGAYTCYACTACTCCYT (SEQ ID NO: 15347) |
| 148 | +CTTTAAYTCYTTATTC + ATRGAYTCY + ACTACTCCYT (SEQ ID NO: 15348) |
| 148 | +CTTTAAY + TCYTTATTCATRGAYTCY + ACTACTCCYT (SEQ ID NO: 15349) |

TABLE 11-continued

| | |
|---|---|
| 148 | +TCYTTATTC + ATRGAYTCY + ACTACTCCYT (SEQ ID NO: 15350) |
| 148 | +TCYTTATTCATRGAYTCY + AC + TACTCCYT (SEQ ID NO: 15351) |
| 148 | +TCYTTATTC + ATRGAYTCYAC + TACTCCYT (SEQ ID NO: 15352) |
| 148 | +ATRGAYTCY + AC + TACTCCYT (SEQ ID NO: 15353) |
| 148 | +ATRGAYTCYAC + TACTCCY + T (SEQ ID NO: 15354) |
| 148 | +ATRGAYTCY + ACTACTCCY + T (SEQ ID NO: 15355) |
| 148 | R + A + TT + TTCTTTAAYTCYTTATTCATRGAYTCYACTACTCCY (SEQ ID NO: 15356) |
| 148 | R + ATT + TTCTTTA + AYTCYTTATTCATRGAYTCYACTACTCCY (SEQ ID NO: 15357) |
| 148 | R + A + TTTTCTTTA + AYTCYTTATTCATRGAYTCYACTACTCCY (SEQ ID NO: 15358) |
| 148 | +TT + TTCTTTA + AYTCYTTATTCATRGAYTCYACTACTCCY (SEQ ID NO: 15359) |
| 148 | +TTTTCTTTA + AYTCYTTAT + TCATRGAYTCYACTACTCCY (SEQ ID NO: 15360) |
| 148 | +TT + TTCTTTAAYTCYTTAT + TCATRGAYTCYACTACTCCY (SEQ ID NO: 15361) |
| 148 | +TTCTTTA + AYTCYTTAT + TCATRGAYTCYACTACTCCY (SEQ ID NO: 15362) |
| 148 | +TTCTTTAAYTCYTTAT + TCATRGAYT + CYACTACTCCY (SEQ ID NO: 15363) |
| 148 | +TTCTTTA + AYTCYTTATTCATRGAYT + CYACTACTCCY (SEQ ID NO: 15364) |
| 148 | +AYTCYTTAT + TCATRGAYT + CYACTACTCCY (SEQ ID NO: 15365) |
| 148 | +AYTCYTTATTCATRGAYT + CY + ACTACTCCY (SEQ ID NO: 15366) |
| 148 | +AYTCYTTAT + TCATRGAYTCY + ACTACTCCY (SEQ ID NO: 15367) |
| 148 | +TCATRGAYT + CY + ACTACTCCY (SEQ ID NO: 15368) |
| 148 | +TCATRGAYTCY + ACTACTC + CY (SEQ ID NO: 15369) |
| 148 | +TCATRGAYT + CYACTACTC + CY (SEQ ID NO: 15370) |
| 148 | TRATTTTCTTTAAYTCYTTATTCATRGAYTCYACTACTCC (SEQ ID NO: 15371) |
| 148 | RATTTTCTTTAAYTCYTTATTCATRGAYTCYACTACTCC (SEQ ID NO: 15372) |
| 148 | TTTTCTTTAAYTCYTTATTCATRGAYTCYACTACTCC (SEQ ID NO: 15373) |
| 148 | TAAYTCYTTATTCATRGAYTCYACTACTCC (SEQ ID NO: 15374) |
| 148 | ATTCATRGAYTCYACTACTCC (SEQ ID NO: 15375) |
| 148 | ATTTTCTTTAAYTCYTTATTCATRGAYTCYACTACTCCYT (SEQ ID NO: 15376) |
| 148 | TTTCTTTAAYTCYTTATTCATRGAYTCYACTACTCCYT (SEQ ID NO: 15377) |
| 148 | TTCTTTAAYTCYTTATTCATRGAYTCYACTACTCCYT (SEQ ID NO: 15378) |
| 148 | CTTTAAYTCYTTATTCATRGAYTCYACTACTCCYT (SEQ ID NO: 15379) |
| 148 | TCYTTATTCATRGAYTCYACTACTCCYT (SEQ ID NO: 15380) |
| 148 | ATRGAYTCYACTACTCCYT (SEQ ID NO: 15381) |
| 148 | RATTTTCTTTAAYTCYTTATTCATRGAYTCYACTACTCCY (SEQ ID NO: 15382) |
| 148 | TTTTCTTTAAYTCYTTATTCATRGAYTCYACTACTCCY (SEQ ID NO: 15383) |
| 148 | TTCTTTAAYTCYTTATTCATRGAYTCYACTACTCCY (SEQ ID NO: 15384) |
| 148 | AYTCYTTATTCATRGAYTCYACTACTCCY (SEQ ID NO: 15385) |

TABLE 11-continued

| | |
|---|---|
| 148 | TCATRGAYTCYACTACTCCY (SEQ ID NO: 15386) |
| 148 | KAYYTGYYCTATRATYTTCTTTAAYTCHTTATTCATRGAYTCYACTACTCC (SEQ ID NO: 15387) |
| 148 | TRATTTTCTTTAAYTCYTTATTCATRGAYTCYACTACTCC + N (SEQ ID NO: 15388) |
| 148 | RATTTTCTTTAAYTCYTTATTCATRGAYTCYACTACTCC + N (SEQ ID NO: 15389) |
| 148 | TTTTCTTTAAYTCYTTATTCATRGAYTCYACTACTCC + N (SEQ ID NO: 15390) |
| 148 | TAAYTCYTTATTCATRGAYTCYACTACTC C + N (SEQ ID NO: 15391) |
| 148 | ATTCATRGAYTCYACTACTCC + N (SEQ ID NO: 15392) |
| 148 | ATTTTCTTTAAYTCYTTATTCATRGAYTCYACTACTCCYT + N (SEQ ID NO: 15393) |
| 148 | TTTCTTTAAYTCYTTATTCATRGAYTCYACTACTCCYT + N (SEQ ID NO: 15394) |
| 148 | TTCTTTAAYTCYTTATTCATRGAYTCYACTACTCCYT + N (SEQ ID NO: 15395) |
| 148 | CTTTAAYTCYTTATTCATRGAYTCYACTACTCCYT + N (SEQ ID NO: 15396) |
| 148 | TCYTTATTCATRGAYTCYACTACTCCYT + N (SEQ ID NO: 15397) |
| 148 | ATRGAYTCYACTACTCCYT + N (SEQ ID NO: 15398) |
| 148 | RATTTTCTTTAAYTCYTTATTCATRGAYTCYACTACTCCY + N (SEQ ID NO: 15399) |
| 148 | TTTTCTTTAAYTCYTTATTCATRGAYTCYACTACTCCY + N (SEQ ID NO: 15400) |
| 148 | TTCTTTAAYTCYTTATTCATRGAYTCYACTACTCCY + N (SEQ ID NO: 15401) |
| 148 | AYTCYTTATTCATRGAYTCYACTACTCCY + N (SEQ ID NO: 15402) |
| 148 | TCATRGAYTCYACTACTCCY + N (SEQ ID NO: 15403) |
| 148 | KAYYTGYYCTATRATYTTCTTTAAYTCHTTATTCATRGAYTCYACTACTCC + N (SEQ ID NO: 15404) |
| 153 | YTCAGCYTGVTCYCTKAYYTGYYCTATRATYTTCTTTAAYTCHTTATTCAT (SEQ ID NO: 15405) |
| 153 | YTCAGCYTGVTCYCTKAYYTGYYCTATRATYTTCTTTAAYTCHTTATTCAT + N (SEQ ID NO: 15406) |
| 155 | +TGNTCYCTK + AC + YTGYCCTATRATTTTCTTTAAYTCYTTAT (SEQ ID NO: 15407) |
| 155 | +TGNTCYCTKAC + YTGYCCT + ATRATTTTCTTTAAYTCYTTAT (SEQ ID NO: 15408) |
| 155 | +TGNTCYCTK + ACYTGYCCT + ATRATTTTCTTTAAYTCYTTAT (SEQ ID NO: 15409) |
| 155 | +AC + YTGYCCT + ATRATTTTCTTTAAYTCYTTAT (SEQ ID NO: 15410) |
| 155 | +ACYTGYCCT + ATR + ATTTTCTTTAAYTCYTTAT (SEQ ID NO: 15411) |
| 155 | +AC + YTGYCCTATR + ATTTTCTTTAAYTCYTTAT (SEQ ID NO: 15412) |
| 155 | +YTGYCCT + ATR + ATTTTCTTTAAYTCYTTAT (SEQ ID NO: 15413) |
| 155 | +YTGYCCTATR + ATTTTC + TTTAAYTCYTTAT (SEQ ID NO: 15414) |
| 155 | +YTGYCCT + ATRATTTTC + TTTAAYTCYTTAT (SEQ ID NO: 15415) |
| 155 | +ATR + ATTTTC + TTTAAYTCYTTAT (SEQ ID NO: 15416) |
| 155 | +ATRATTTTC + TTTAAYTCY + TTAT (SEQ ID NO: 15417) |
| 155 | +ATR + ATTTTCTTTAAYTCY + TTAT (SEQ ID NO: 15418) |
| 155 | +ATTTTC + TTTAAYTCY + TTAT (SEQ ID NO: 15419) |
| 155 | +ATTTTCTTTAAYTCY + TT + AT (SEQ ID NO: 15420) |
| 155 | +ATTTTC + TTTAAYTCYTT + AT (SEQ ID NO: 15421) |

TABLE 11-continued

| | |
|---|---|
| 155 | +TTTAAYTCY + TT + AT (SEQ ID NO: 15422) |
| 155 | +TTTAAYTCYTT + A + T (SEQ ID NO: 15423) |
| 155 | +TTTAAYTCY + TTA + T (SEQ ID NO: 15424) |
| 155 | YTGNTCYC + TK + ACYTGYC + CTATRATTTTCTTTAAYTCYTTA (SEQ ID NO: 15425) |
| 155 | YTGNTCYC + TKACYTGYC + CTA + TRATTTTCTTTAAYTCYTTA (SEQ ID NO: 15426) |
| 155 | YTGNTCYC + TK + ACYTGYCCTA + TRATTTTCTTTAAYTCYTTA (SEQ ID NO: 15427) |
| 155 | +ACYTGYC + CTA + TRATTTTCTTTAAYTCYTTA (SEQ ID NO: 15428) |
| 155 | +ACYTGYCCTA + TRATTT + TCTTTAAYTCYTTA (SEQ ID NO: 15429) |
| 155 | +ACYTGYC + CTATRATTT + TCTTTAAYTCYTTA (SEQ ID NO: 15430) |
| 155 | +CTA + TRATTT + TCTTTAAYTCYTTA (SEQ ID NO: 15431) |
| 155 | +CTATRATTT + TCTTTAAYT + CYTTA (SEQ ID NO: 15432) |
| 155 | +CTA + TRATTTTCTTTAAYT + CYTTA (SEQ ID NO: 15433) |
| 155 | +TRATTT + TCTTTAAYT + CYTTA (SEQ ID NO: 15434) |
| 155 | +TRATTTTCTTTAAYT + CY + TTA (SEQ ID NO: 15435) |
| 155 | +TRATTT + TCTTTAAYTCY + TTA (SEQ ID NO: 15436) |
| 155 | +TCTTTAAYT + CY + TTA (SEQ ID NO: 15437) |
| 155 | +TCTTTAAYTCY + T + TA (SEQ ID NO: 15438) |
| 155 | +TCTTTAAYT + CYT + TA (SEQ ID NO: 15439) |
| 155 | TGNTCYCTKACYTGYCCTATRATTTTCTTTAAYTCYTTAT (SEQ ID NO: 15440) |
| 155 | ACYTGYCCTATRATTTTCTTTAAYTCYTTAT (SEQ ID NO: 15441) |
| 155 | YTGYCCTATRATTTTCTTTAAYTCYTTAT (SEQ ID NO: 15442) |
| 155 | ATRATTTTCTTTAAYTCYTTAT (SEQ ID NO: 15443) |
| 155 | ATTTTCTTTAAYTCYTTAT (SEQ ID NO: 15444) |
| 155 | TTTAAYTCYTTAT (SEQ ID NO: 15445) |
| 155 | YTGNTCYCTKACYTGYCCTATRATTTTCTTTAAYTCYTTA (SEQ ID NO: 15446) |
| 155 | ACYTGYCCTATRATTTTCTTTAAYTCYTTA (SEQ ID NO: 15447) |
| 155 | CTATRATTTTCTTTAAYTCYTTA (SEQ ID NO: 15448) |
| 155 | TRATTTTCTTTAAYTCYTTA (SEQ ID NO: 15449) |
| 155 | TCTTTAAYTCYTTA (SEQ ID NO: 15450) |
| 155 | AAGRTGYTCAGCYTGVTCYCTKAYYTGYYCTATRATYTTCTTTAATTCTTT (SEQ ID NO: 15451) |
| 155 | TGNTCYCTKACYTGYCCTATRATTTTCTTTAAYTCYTTAT + N (SEQ ID NO: 15452) |
| 155 | ACYTGYCCTATRATTTTCTTTAAYTCYTTAT + N (SEQ ID NO: 15453) |
| 155 | YTGYCCTATRATTTTCTTTAAYTCYTTAT + N (SEQ ID NO: 15454) |
| 155 | ATRATTTTCTTTAAYTCYTTAT + N (SEQ ID NO: 15455) |
| 155 | ATTTTCTTTAAYTCYTTAT + N (SEQ ID NO: 15456) |
| 155 | TTTAAYTCYTTAT + N (SEQ ID NO: 15457) |
| 155 | YTGNTCYCTKACYTGYCCTATRATTTTCTTTAAYTCYTTA + N (SEQ ID NO: 15458) |

TABLE 11-continued

| | |
|---|---|
| 155 | ACYTGYCCTATRATTTTCTTTAAYTCYTTA + N (SEQ ID NO: 15459) |
| 155 | CTATRATTTTCTTTAAYTCYTTA + N (SEQ ID NO: 15460) |
| 155 | TRATTTTCTTTAAYTCYTTA + N (SEQ ID NO: 15461) |
| 155 | TCTTTAAYTCYTTA + N (SEQ ID NO: 15462) |
| 155 | AAGRTGYTCAGCYTGVTCYCTKAYYTGYYCTATRATYTTCTTTAATTCTTT + N (SEQ ID NO: 15463) |
| 163 | ACT + GCTGTYTTA + AG + RTGYTCAGCYTGNTCYCTKACYTGYC (SEQ ID NO: 15464) |
| 163 | +ACT + GCTGTYTTAAG + RTGYTCAGCYTGNTCYCTKACYTGYC (SEQ ID NO: 15465) |
| 163 | +AG + R + TGYTCAGCYTGNTCYCTKACYTGYC (SEQ ID NO: 15466) |
| 163 | +AGR + TGYTCAGCYTGNTCYCT + KACYTGYC (SEQ ID NO: 15467) |
| 163 | +AG + RTGYTCAGCYTGNTCYCT + KACYTGYC (SEQ ID NO: 15468) |
| 163 | +R + TGYTCAGCYTGNTCYCT + KACYTGYC (SEQ ID NO: 15469) |
| 163 | +RTGYTCAGCYTGNTCYCT + K + ACYTGYC (SEQ ID NO: 15470) |
| 163 | +R + TGYTCAGCYTGNTCYCTK + ACYTGYC (SEQ ID NO: 15471) |
| 163 | +TGYTCAGCYTGNTCYCT + K + ACYTGYC (SEQ ID NO: 15472) |
| 163 | +TGYTCAGCYTGNTCYCTK + AC + YTGYC (SEQ ID NO: 15473) |
| 163 | +TGYTCAGCYTGNTCYCT + KAC + YTGYC (SEQ ID NO: 15474) |
| 163 | ACTGCTGTYTTAAGRTGYTCAGCYTGNTCYCTKACYTGYC (SEQ ID NO: 15475) |
| 163 | AGRTGYTCAGCYTGNTCYCTKACYTGYC (SEQ ID NO: 15476) |
| 163 | RTGYTCAGCYTGNTCYCTKACYTGYC (SEQ ID NO: 15477) |
| 163 | TGYTCAGCYTGNTCYCTKACYTGYC (SEQ ID NO: 15478) |
| 163 | TACTGCCATYTGTACTGCTGTYTTAAGRTGYTCAGCYTGVTCYCTTACCTG (SEQ ID NO: 15479) |
| 163 | ACTGCTGTYTTAAGRTGYTCAGCYTGNTCYCTKACYTGYC + N (SEQ ID NO: 15480) |
| 163 | AGRTGYTCAGCYTGNTCYCTKACYTGYC + N (SEQ ID NO: 15481) |
| 163 | RTGYTCAGCYTGNTCYCTKACYTGYC + N (SEQ ID NO: 15482) |
| 163 | TGYTCAGCYTGNTCYCTKACYTGYC + N (SEQ ID NO: 15483) |
| 163 | TACTGCCATYTGTACTGCTGTYTTAAGRTGYTCAGCYTGVTCYCTTACCTG + N (SEQ ID NO: 15484) |
| 230 | C + ARA + GN + AGYTTKGCTGGTCCTTTCCAAAKDGGRTCTCTGC (SEQ ID NO: 15485) |
| 230 | +C + ARAGN + AGYTTKGCTGGTCCTTTCCAAAKDGGRTCTCTGC (SEQ ID NO: 15486) |
| 230 | +GN + AG + YTTKGCTGGTCCTTTCCAAAKDGGRTCTCTGC (SEQ ID NO: 15487) |
| 230 | +GNAG + Y + TTKGCTGGTCCTTTCCAAAKDGGRTCTCTGC (SEQ ID NO: 15488) |
| 230 | +GN + AGY + TTKGCTGGTCCTTTCCAAAKDGGRTCTCTGC (SEQ ID NO: 15489) |
| 230 | +AG + Y + TTKGCTGGTCCTTTCCAAAKDGGRTCTCTGC (SEQ ID NO: 15490) |
| 230 | +AGY + TTKGC + TGGTCCTTTCCAAAKDGGRTCTCTGC (SEQ ID NO: 15491) |
| 230 | +AG + YTTKGC + TGGTCCTTTCCAAAKDGGRTCTCTGC (SEQ ID NO: 15492) |
| 230 | +Y + TTKGC + TGGTCCTTTCCAAAKDGGRTCTCTGC (SEQ ID NO: 15493) |
| 230 | +YTTKGC + T + GGTCCTTTCCAAAKDGGRTCTCTGC (SEQ ID NO: 15494) |

TABLE 11-continued

230 +Y + TTKGCT + GGTCCTTTCCAAAKDGGRTCTCTGC (SEQ ID NO: 15495)

230 +TTKGC + T + GGTCCTTTCCAAAKDGGRTCTCTGC (SEQ ID NO: 15496)

230 +TTKGCT + G + GTCCTTTCCAAAKDGGRTCTCTGC (SEQ ID NO: 15497)

230 +TTKGC + TG + GTCCTTTCCAAAKDGGRTCTCTGC (SEQ ID NO: 15498)

230 +T + G + GTCCTTTCCAAAKDGGRTCTCTGC (SEQ ID NO: 15499)

230 +TG + G + TCCTTTCCAAAKDGGRTCTCTGC (SEQ ID NO: 15500)

230 +T + GG + TCCTTTCCAAAKDGGRTCTCTGC (SEQ ID NO: 15501)

230 CARAGNAGYTTKGCTGGTCCTTTCCAAAKDGGRTCTCTGC (SEQ ID NO: 15502)

230 GNAGYTTKGCTGGTCCTTTCCAAAKDGGRTCTCTGC (SEQ ID NO: 15503)

230 AGYTTKGCTGGTCCTTTCCAAAKDGGRTCTCTGC (SEQ ID NO: 15504)

230 YTTKGCTGGTCCTTTCCAAAKDGGRTCTCTGC (SEQ ID NO: 15505)

230 TTKGCTGGTCCTTTCCAAAKDGGRTCTCTGC (SEQ ID NO: 15506)

230 TGGTCCTTTCCAAAKDGGRTCTCTGC (SEQ ID NO: 15507)

230 CCCTTCACCTTTCCARAGDAGYTTKGCTGGTCCTTTCCAAABDGGGTCTCT (SEQ ID NO: 15508)

230 CARAGNAGYTTKGCTGGTCCTTTCCAAAKDGGRTCTCTGC + N (SEQ ID NO: 15509)

230 GNAGYTTKGCTGGTCCTTTCCAAAKDGGRTCTCTGC + N (SEQ ID NO: 15510)

230 AGYTTKGCTGGTCCTTTCCAAAKDGGRTCTCTGC + N (SEQ ID NO: 15511)

230 YTTKGCTGGTCCTTTCCAAAKDGGRTCTCTGC + N (SEQ ID NO: 15512)

230 TTKGCTGGTCCTTTCCAAAKDGGRTCTCTGC + N (SEQ ID NO: 15513)

230 TGGTCCTTTCCAAAKDGGRTCTCTGC + N (SEQ ID NO: 15514)

230 CCCTTCACCTTTCCARAGDAGYTTKGCTGGTCCTTTCCAAABDGGGTCTCT + N (SEQ ID NO: 15515)

263 T + GCCATC + T + GTTTTCCATARTCYYTAATRATYTTTRCTTTY (SEQ ID NO: 15516)

263 +T + GCCATCT + GTTTTCCATARTCYYTAATRATYTTTRCTTTY (SEQ ID NO: 15517)

263 +T + GT + TTTCCATARTCYYTAATRATYTTTRCTTTY (SEQ ID NO: 15518)

263 +TGT + T + TTCCATARTCYYTAATRATYTTTRCTTTY (SEQ ID NO: 15519)

263 +T + GTT + TTCCATARTCYYTAATRATYTTTRCTTTY (SEQ ID NO: 15520)

263 +GT + T + TTCCATARTCYYTAATRATYTTTRCTTTY (SEQ ID NO: 15521)

263 +GTT + TTC + CATARTCYYTAATRATYTTTRCTTTY (SEQ ID NO: 15522)

263 +GT + TTTC + CATARTCYYTAATRATYTTTRCTTTY (SEQ ID NO: 15523)

263 +T + TTC + CATARTCYYTAATRATYTTTRCTTTY (SEQ ID NO: 15524)

263 +TTTC + CATARTCYYTA + ATRATYTTTRCTTTY (SEQ ID NO: 15525)

263 +T + TTCCATARTCYYTA + ATRATYTTTRCTTTY (SEQ ID NO: 15526)

263 +TTC + CATARTCYYTA + ATRATYTTTRCTTTY (SEQ ID NO: 15527)

263 +TTCCATARTCYYTA + A + TRATYTTTRCTTTY (SEQ ID NO: 15528)

263 +TTC + CATARTCYYTAA + TRATYTTTRCTTTY (SEQ ID NO: 15529)

263 +CATARTCYYTA + A + TRATYTTTRCTTTY (SEQ ID NO: 15530)

263 +CATARTCYYTAA + TRATY + TTTRCTTTY (SEQ ID NO: 15531)

TABLE 11-continued

| 263 | +CATARTCYYTA + ATRATY + TTTRCTTTY (SEQ ID NO: 15532) |
| --- | --- |
| 263 | TGCCATCTGTTTTCCATARTCYYTAATRATYTTTRCTTTY (SEQ ID NO: 15533) |
| 263 | TGTTTTCCATARTCYYTAATRATYTTTRCTTTY (SEQ ID NO: 15534) |
| 263 | GTTTTCCATARTCYYTAATRATYTTTRCTTTY (SEQ ID NO: 15535) |
| 263 | TTTCCATARTCYYTAATRATYTTTRCTTTY (SEQ ID NO: 15536) |
| 263 | TTCCATARTCYYTAATRATYTTTRCTTTY (SEQ ID NO: 15537) |
| 263 | CATARTCYYTAATRATYTTTRCTTTY (SEQ ID NO: 15538) |
| 263 | ACAATCAKCACCTGCCATCTGTTTTCCATARTCYYTRATRATYTTTGCTTT (SEQ ID NO: 15539) |
| 263 | TGCCATCTGTTTTCCATARTCYYTAATRATYTTTRCTTTY + N (SEQ ID NO: 15540) |
| 263 | TGTTTTCCATARTCYYTAATRATYTTTRCTTTY + N (SEQ ID NO: 15541) |
| 263 | GTTTTCCATARTCYYTAATRATYTTTRCTTTY + N (SEQ ID NO: 15542) |
| 263 | TTTCCATARTCYYTAATRATYTTTRCTTTY + N (SEQ ID NO: 15543) |
| 263 | TTCCATARTCYYTAATRATYTTTRCTTTY + N (SEQ ID NO: 15544) |
| 263 | CATARTCYYTAATRATYTTTRCTTTY + N (SEQ ID NO: 15545) |

Table 12 depicts amino acid substitutions in HIV-1 integrase protein

TABLE 12

| Codon | Single Letter Amino Acid Code | Amino Acid |
| --- | --- | --- |
| 51 | Y | Tyrosine |
| 66 | I | Isoleucine |
| 66 | A | Alanine |
| 66 | K | Lysine |
| 74 | M | Methionine |
| 92 | Q | Glutamine |
| 92 | G | Glycine |
| 92 | V | Valine |
| 97 | A | Alanine |
| 118 | R | Arginine |
| 121 | Y | Tyrosine |
| 138 | K | Lysine |
| 138 | A | Alanine |
| 140 | S | Serine |
| 140 | A | Alanine |
| 140 | C | Cysteine |
| 143 | C | Cysteine |
| 143 | R | Arginine |
| 143 | H | Histidine |
| 143 | K | Lysine |
| 143 | S | Serine |
| 143 | G | Glycine |
| 143 | A | Alanine |
| 145 | S | Serine |
| 146 | P | Proline |
| 147 | G | Glycine |
| 148 | H | Histidine |
| 148 | R | Arginine |
| 148 | K | Lysine |
| 153 | Y | Tyrosine |
| 153 | F | Phenylalanine |
| 155 | H | Histidine |
| 155 | S | Serine |
| 155 | T | Threonine |
| 163 | R | Arginine |
| 163 | K | Lysine |

TABLE 12-continued

| Codon | Single Letter Amino Acid Code | Amino Acid |
| --- | --- | --- |
| 230 | R | Arginine |
| 263 | K | Lysine |

Table 13 depicts wild-type and mutant probes for the HIV-1 integrase protein. A "+" symbol preceding a nucleotide denotes that the nucleotide is an LNA.

TABLE 13

| Codon | Wild-Type Probe (5' to 3') |
| --- | --- |
| 51 | AGCCATGCATGGACA (SEQ ID NO: 15546) |
| 66 | YTAGAYT + GYACACAYYTAG (SEQ ID NO: 15547) |
| 66 | Y + TAGAYTGYACACAYYTAG (SEQ ID NO: 15548) |
| 66 | YTAGAY + TGYACACAYYTAG (SEQ ID NO: 15549) |
| 66 | YT + AGAYTGYACACAYYTAG (SEQ ID NO: 15550) |
| 66 | YTAGAYTGYACACA + YYTAG (SEQ ID NO: 15551) |
| 66 | YTAGAYTGYACACAYY + TAG (SEQ ID NO: 15552) |
| 66 | YTAGAYTGYA + CACAYYTAG (SEQ ID NO: 15553) |
| 66 | YTAGAYTGYACAC + AYYTAG (SEQ ID NO: 15554) |
| 66 | YTAG + AYTG + YA + CACAYYTAG (SEQ ID NO: 15555) |
| 66 | YT + AGAYTG + YA + CACAYYTAG (SEQ ID NO: 15556) |
| 66 | YTAGAYT + G + YA + CACAYYTAG (SEQ ID NO: 15557) |
| 66 | YTA + GAYTG + YA + CACAYYTAG (SEQ ID NO: 15558) |

TABLE 13-continued

| | |
|---|---|
| 66 | YTAGAYTG + YA + CAC + AYYTAG (SEQ ID NO: 15559) |
| 66 | YTAGAYTG + YA + CA + CAYYTAG (SEQ ID NO: 15560) |
| 66 | YTAGAYTG + YA + CACAY + YTAG (SEQ ID NO: 15561) |
| 66 | YTAGAYTG + YA + CACAYY + TAG (SEQ ID NO: 15562) |
| 66 | TAGAYT + GYACACAYYTAGA (SEQ ID NO: 15563) |
| 66 | TAGA + YTGYACACAYYTAGA (SEQ ID NO: 15564) |
| 66 | TAGAYTG + YACACAYYTAGA (SEQ ID NO: 15565) |
| 66 | TA + GAYTGYACACAYYTAGA (SEQ ID NO: 15566) |
| 66 | TAGAYTGYACAC + AYYTAGA (SEQ ID NO: 15567) |
| 66 | TAGAYTGYACACAYYT + AGA (SEQ ID NO: 15568) |
| 66 | TAGAYTGYAC + ACAYYTAGA (SEQ ID NO: 15569) |
| 66 | TAGAYTGYACACAY + YTAGA (SEQ ID NO: 15570) |
| 66 | TAGAYT + GY + AC + ACAYYTAGA (SEQ ID NO: 15571) |
| 66 | TAGAY + TGY + AC + ACAYYTAGA (SEQ ID NO: 15572) |
| 66 | T + AGAYTGY + AC + ACAYYTAGA (SEQ ID NO: 15573) |
| 66 | TA + GAYTGY + AC + ACAYYTAGA (SEQ ID NO: 15574) |
| 66 | TAGAYTGY + AC + ACAYYTA + GA (SEQ ID NO: 15575) |
| 66 | TAGAYTGY + AC + ACAYYT + AGA (SEQ ID NO: 15576) |
| 66 | TAGAYTGY + AC + ACA + YYTAGA (SEQ ID NO: 15577) |
| 66 | TAGAYTGY + AC + ACAYY + TAGA (SEQ ID NO: 15578) |
| 66 | TAGAY + TGYACACAYYTAGA (SEQ ID NO: 15579) |
| 66 | TAGAYTGYACACAYYTA + GA (SEQ ID NO: 15580) |
| 66 | TAGAYTGYACA + CAYYTAGA (SEQ ID NO: 15581) |
| 66 | TAGAYTGYACACA + YYTAGA (SEQ ID NO: 15582) |
| 66 | TAGA + YTGY + AC + ACAYYTAGA (SEQ ID NO: 15583) |
| 66 | TAGAYTG + Y + AC + ACAYYTAGA (SEQ ID NO: 15584) |
| 66 | TAGAYTGY + AC + A + CAYYTAGA (SEQ ID NO: 15585) |
| 66 | TAGAYTGY + AC + ACAY + YTAGA (SEQ ID NO: 15586) |
| 66 | TAGAYT + GYACACAYYTA (SEQ ID NO: 15587) |
| 66 | +TAGAYTGYACACAYYTA (SEQ ID NO: 15588) |
| 66 | TAGAY + TGYACACAYYTA (SEQ ID NO: 15589) |
| 66 | T + AGAYTGYACACAYYTA (SEQ ID NO: 15590) |
| 66 | TAGAYTGYACACA + YYTA (SEQ ID NO: 15591) |
| 66 | TAGAYTGYACACAYY + TA (SEQ ID NO: 15592) |
| 66 | TAGAYTGYA + CACAYYTA (SEQ ID NO: 15593) |
| 66 | TAGAYTGYACAC + AYYTA (SEQ ID NO: 15594) |
| 66 | TAG + AYTG + YA + CACAYYTA (SEQ ID NO: 15595) |
| 66 | T + AGAYTG + YA + CACAYYTA (SEQ ID NO: 15596) |
| 66 | TAGAYT + G + YA + CACAYYTA (SEQ ID NO: 15597) |
| 66 | TA + GAYTG + YA + CACAYYTA (SEQ ID NO: 15598) |
| 66 | TAGAYTG + YA + CAC + AYYTA (SEQ ID NO: 15599) |
| 66 | TAGAYTG + YA + CA + CAYYTA (SEQ ID NO: 15600) |
| 66 | TAGAYTG + YA + CACAY + YTA (SEQ ID NO: 15601) |
| 66 | TAGAYTG + YA + CACAYY + TA (SEQ ID NO: 15602) |
| 66 | AGAYT + GYACACAYYTAG (SEQ ID NO: 15603) |
| 66 | AGA + YTGYACACAYYTAG (SEQ ID NO: 15604) |
| 66 | AGAYTG + YACACAYYTAG (SEQ ID NO: 15605) |
| 66 | A + GAYTGYACACAYYTAG (SEQ ID NO: 15606) |
| 66 | AGAYTGYACAC + AYYTAG (SEQ ID NO: 15607) |
| 66 | AGAYTGYACACAYYT + AG (SEQ ID NO: 15608) |
| 66 | AGAYTGYAC + ACAYYTAG (SEQ ID NO: 15609) |
| 66 | AGAYTGYACACAY + YTAG (SEQ ID NO: 15610) |
| 66 | AGAYT + GY + AC + ACAYYTAG (SEQ ID NO: 15611) |
| 66 | AGAY + TGY + AC + ACAYYTAG (SEQ ID NO: 15612) |
| 66 | +AGAYTGY + AC + ACAYYTAG (SEQ ID NO: 15613) |
| 66 | A + GAYTGY + AC + ACAYYTAG (SEQ ID NO: 15614) |
| 66 | AGAYTGY + AC + ACAYYTA + G (SEQ ID NO: 15615) |
| 66 | AGAYTGY + AC + ACAYYT + AG (SEQ ID NO: 15616) |
| 66 | AGAYTGY + AC + ACA + YYTAG (SEQ ID NO: 15617) |
| 66 | AGAYTGY + AC + ACAYY + TAG (SEQ ID NO: 15618) |
| 66 | AGAY + TGYACACAYYTAG (SEQ ID NO: 15619) |
| 66 | AGAYTGYACACAYYTA + G (SEQ ID NO: 15620) |
| 66 | AGAYTGYACA + CAYYTAG (SEQ ID NO: 15621) |
| 66 | AGAYTGYACACA + YYTAG (SEQ ID NO: 15622) |

TABLE 13-continued

| | | |
|---|---|---|
| 66 | AGA + YTGY + AC + ACAYYTAG (SEQ ID NO: 15623) | |
| 66 | AGAYTG + Y + AC + ACAYYTAG (SEQ ID NO: 15624) | |
| 66 | AGAYTGY + AC + A + CAYYTAG (SEQ ID NO: 15625) | |
| 66 | AGAYTGY + AC + ACAY + YTAG (SEQ ID NO: 15626) | |
| 66 | TAGAYT + GYACACAYY (SEQ ID NO: 15627) | |
| 66 | +TAGAYTGYACACAYY (SEQ ID NO: 15628) | |
| 66 | TAGAY + TGYACACAYY (SEQ ID NO: 15629) | |
| 66 | T + AGAYTGYACACAYY (SEQ ID NO: 15630) | |
| 66 | TAGAYTGYACACA + YY (SEQ ID NO: 15631) | |
| 66 | TAGAYTGYACACAYY (SEQ ID NO: 15632) | |
| 66 | TAGAYTGYA + CACAYY (SEQ ID NO: 15633) | |
| 66 | TAGAYTGYACAC + AYY (SEQ ID NO: 15634) | |
| 66 | TAG + AYTG + YA + CACAYY (SEQ ID NO: 15635) | |
| 66 | T + AGAYTG + YA + CACAYY (SEQ ID NO: 15636) | |
| 66 | TAGAYT + G + YA + CACAYY (SEQ ID NO: 15637) | |
| 66 | TA + GAYTG + YA + CACAYY (SEQ ID NO: 15638) | |
| 66 | TAGAYTG + YA + CAC + AYY (SEQ ID NO: 15639) | |
| 66 | TAGAYTG + YA + CA + CAYY (SEQ ID NO: 15640) | |
| 66 | TAGAYTG + YA + CACAY + Y (SEQ ID NO: 15641) | |
| 66 | TAGAYTG + YA + CACAYY (SEQ ID NO: 15642) | |
| 66 | AGAYT + GYACACAYYT (SEQ ID NO: 15643) | |
| 66 | AGA + YTGYACACAYYT (SEQ ID NO: 15644) | |
| 66 | AGAYTG + YACACAYYT (SEQ ID NO: 15645) | |
| 66 | A + GAYTGYACACAYYT (SEQ ID NO: 15646) | |
| 66 | AGAYTGYACAC + AYYT (SEQ ID NO: 15647) | |
| 66 | AGAYTGYACACAYYT (SEQ ID NO: 15648) | |
| 66 | AGAYTGYAC + ACAYYT (SEQ ID NO: 15649) | |
| 66 | AGAYTGYACACAY + YT (SEQ ID NO: 15650) | |
| 66 | AGAYT + GY + AC + ACAYYT (SEQ ID NO: 15651) | |
| 66 | AGAY + TGY + AC + ACAYYT (SEQ ID NO: 15652) | |
| 66 | +AGAYTGY + AC + ACAYYT (SEQ ID NO: 15653) | |
| 66 | A + GAYTGY + AC + ACAYYT (SEQ ID NO: 15654) | |
| 66 | AGAYTGY + AC + ACAYYTA (SEQ ID NO: 15655) | |
| 66 | AGAYTGY + AC + ACAYYT (SEQ ID NO: 15656) | |
| 66 | AGAYTGY + AC + ACA + YYT (SEQ ID NO: 15657) | |
| 66 | AGAYTGY + AC + ACAYY + T (SEQ ID NO: 15658) | |
| 66 | AGAY + TGYACACAYYT (SEQ ID NO: 15659) | |
| 66 | AGAYTGYACACAYYTA (SEQ ID NO: 15660) | |
| 66 | AGAYTGYACA + CAYYT (SEQ ID NO: 15661) | |
| 66 | AGAYTGYACACA + YYT (SEQ ID NO: 15662) | |
| 66 | AGA + YTGY + AC + ACAYYT (SEQ ID NO: 15663) | |
| 66 | AGAYTG + Y + AC + ACAYYT (SEQ ID NO: 15664) | |
| 66 | AGAYTGY + AC + A + CAYYT (SEQ ID NO: 15665) | |
| 66 | AGAYTGY + AC + ACAY + YT (SEQ ID NO: 15666) | |
| 66 | TAGAYT + GYACACA (SEQ ID NO: 15667) | |
| 66 | +TAGAYTGYACACA (SEQ ID NO: 15668) | |
| 66 | TAGAY + TGYACACA (SEQ ID NO: 15669) | |
| 66 | T + AGAYTGYACACA (SEQ ID NO: 15670) | |
| 66 | TAGAYTGYACACA (SEQ ID NO: 15671) | |
| 66 | TAGAYTGYACACAY (SEQ ID NO: 15672) | |
| 66 | TAGAYTGYA + CACA (SEQ ID NO: 15673) | |
| 66 | TAGAYTGYACAC + A (SEQ ID NO: 15674) | |
| 66 | TAG + AYTG + YA + CACA (SEQ ID NO: 15675) | |
| 66 | T + AGAYTG + YA + CACA (SEQ ID NO: 15676) | |
| 66 | TAGAYT + G + YA + CACA (SEQ ID NO: 15677) | |
| 66 | TA + GAYTG + YA + CACA (SEQ ID NO: 15678) | |
| 66 | TAGAYTG + YA + CAC + A (SEQ ID NO: 15679) | |
| 66 | TAGAYTG + YA + CA + CA (SEQ ID NO: 15680) | |
| 66 | TAGAYTG + YA + CACAY (SEQ ID NO: 15681) | |
| 66 | AGAYT + GYACACAY (SEQ ID NO: 15682) | |
| 66 | AGA + YTGYACACAY (SEQ ID NO: 15683) | |
| 66 | AGAYTG + YACACAY (SEQ ID NO: 15684) | |
| 66 | A + GAYTGYACACAY (SEQ ID NO: 15685) | |
| 66 | AGAYTGYACAC + AY (SEQ ID NO: 15686) | |
| 66 | AGAYTGYACACAYY (SEQ ID NO: 15687) | |
| 66 | AGAYTGYAC + ACAY (SEQ ID NO: 15688) | |
| 66 | AGAYTGYACACAY (SEQ ID NO: 15689) | |
| 66 | AGAYT + GY + AC + ACAY (SEQ ID NO: 15690) | |
| 66 | AGAY + TGY + AC + ACAY (SEQ ID NO: 15691) | |
| 66 | +AGAYTGY + AC + ACAY (SEQ ID NO: 15692) | |

TABLE 13-continued

| | | |
|---|---|---|
| 66 | A + GAYTGY + AC + ACAY | (SEQ ID NO: 15693) |
| 66 | AGAYTGY + AC + ACAYY | (SEQ ID NO: 15694) |
| 66 | AGAYTGY + AC + ACA + Y | (SEQ ID NO: 15695) |
| 66 | AGAY + TGYACACAY | (SEQ ID NO: 15696) |
| 66 | AGAYTGYACA + CAY | (SEQ ID NO: 15697) |
| 66 | AGAYTGYACACA + Y | (SEQ ID NO: 15698) |
| 66 | AGA + YTGY + AC + ACAY | (SEQ ID NO: 15699) |
| 66 | AGAYTG + Y + AC + ACAY | (SEQ ID NO: 15700) |
| 66 | AGAYTGY + AC + A + CAY | (SEQ ID NO: 15701) |
| 66 | AGAYTGY + AC + ACAY | (SEQ ID NO: 15702) |
| 66 | YTAGAYTGYACACAYYTAG | (SEQ ID NO: 15703) |
| 66 | TAGAYTGYACACAYYTAGA | (SEQ ID NO: 15704) |
| 66 | TAGAYTGYACACAYYTA | (SEQ ID NO: 15705) |
| 66 | AGAYTGYACACAYYTAG | (SEQ ID NO: 15706) |
| 66 | TAGAYTGYACACAYY | (SEQ ID NO: 15707) |
| 66 | AGAYTGYACACAYYT | (SEQ ID NO: 15708) |
| 66 | TAGAYTGYACACA | (SEQ ID NO: 15709) |
| 66 | AGAYTGYACACAY | (SEQ ID NO: 15710) |
| 66 | TAAATGKGTACAATC | (SEQ ID NO: 15711) |
| 74 | AAA + RTHATYYTRGTAGCAG | (SEQ ID NO: 15712) |
| 74 | A + AARTHATYYTRGTAGCAG | (SEQ ID NO: 15713) |
| 74 | AA + ARTHATYYTRGTAGCAG | (SEQ ID NO: 15714) |
| 74 | AAARTH + ATYYTRGTAGCAG | (SEQ ID NO: 15715) |
| 74 | AAARTHATYYTR + GTAGCAG | (SEQ ID NO: 15716) |
| 74 | AAARTHATYYTRGTAGC + AG | (SEQ ID NO: 15717) |
| 74 | AAARTHATYYTRGTAG + CAG | (SEQ ID NO: 15718) |
| 74 | AAARTHATYYTRGTAGCA + G | (SEQ ID NO: 15719) |
| 74 | AA + ARTHAT + YY + TRGTAGCAG (SEQ ID NO: 15720) | |
| 74 | A + AARTHAT + YY + TRGTAGCAG (SEQ ID NO: 15721) | |
| 74 | AAARTH + AT + YY + TRGTAGCAG (SEQ ID NO: 15722) | |
| 74 | AAA + RTHAT + YY + TRGTAGCAG (SEQ ID NO: 15723) | |
| 74 | AAARTHAT + YY + TRGT + AGCAG (SEQ ID NO: 15724) | |
| 74 | AAARTHAT + YY + TRG + TAGCAG (SEQ ID NO: 15725) | |
| 74 | AAARTHAT + YY + TRGTA + GCAG (SEQ ID NO: 15726) | |
| 74 | AAARTHAT + YY + TR + GTAGCAG (SEQ ID NO: 15727) | |
| 74 | AA + RTHATYYTRGTAGCA | (SEQ ID NO: 15728) |
| 74 | +AARTHATYYTRGTAGCA | (SEQ ID NO: 15729) |
| 74 | A + ARTHATYYTRGTAGCA | (SEQ ID NO: 15730) |
| 74 | AARTH + ATYYTRGTAGCA | (SEQ ID NO: 15731) |
| 74 | AARTHATYYTR + GTAGCA | (SEQ ID NO: 15732) |
| 74 | AARTHATYYTRGTAGC + A | (SEQ ID NO: 15733) |
| 74 | AARTHATYYTRGTAG + CA | (SEQ ID NO: 15734) |
| 74 | AARTHATYYTRGTAGCA | (SEQ ID NO: 15735) |
| 74 | A + ARTHAT + YY + TRGTAGCA (SEQ ID NO: 15736) | |
| 74 | +AARTHAT + YY + TRGTAGCA (SEQ ID NO: 15737) | |
| 74 | AARTH + AT + YY + TRGTAGCA (SEQ ID NO: 15738) | |
| 74 | AA + RTHAT + YY + TRGTAGCA (SEQ ID NO: 15739) | |
| 74 | AARTHAT + YY + TRGT + AGCA (SEQ ID NO: 15740) | |
| 74 | AARTHAT + YY + TRG + TAGCA (SEQ ID NO: 15741) | |
| 74 | AARTHAT + YY + TRGTA + GCA (SEQ ID NO: 15742) | |
| 74 | AARTHAT + YY + TR + GTAGCA (SEQ ID NO: 15743) | |
| 74 | AA + RTHATYYTRGTAG | (SEQ ID NO: 15744) |
| 74 | +AARTHATYYTRGTAG | (SEQ ID NO: 15745) |
| 74 | A + ARTHATYYTRGTAG | (SEQ ID NO: 15746) |
| 74 | AARTH + ATYYTRGTAG | (SEQ ID NO: 15747) |
| 74 | AARTHATYYTR + GTAG | (SEQ ID NO: 15748) |
| 74 | AARTHATYYTRGTAGC | (SEQ ID NO: 15749) |
| 74 | AARTHATYYTRGTAG | (SEQ ID NO: 15750) |
| 74 | A + ARTHAT + YY + TRGTAG (SEQ ID NO: 15751) | |
| 74 | +AARTHAT + YY + TRGTAG | (SEQ ID NO: 15752) |
| 74 | AARTH + AT + YY + TRGTAG (SEQ ID NO: 15753) | |
| 74 | AA + RTHAT + YY + TRGTAG (SEQ ID NO: 15754) | |
| 74 | AARTHAT + YY + TRGT + AG (SEQ ID NO: 15755) | |
| 74 | AARTHAT + YY + TRG + TAG (SEQ ID NO: 15756) | |
| 74 | AARTHAT + YY + TRGTA + G (SEQ ID NO: 15757) | |
| 74 | AARTHAT + YY + TR + GTAG (SEQ ID NO: 15758) | |
| 74 | AA + RTHATYYTRGT | (SEQ ID NO: 15759) |
| 74 | +AARTHATYYTRGT | (SEQ ID NO: 15760) |

TABLE 13-continued

| | |
|---|---|
| 74 | A + ARTHATYYTRGT (SEQ ID NO: 15761) |
| 74 | AARTH + ATYYTRGT (SEQ ID NO: 15762) |
| 74 | AARTHATYYTR + GT (SEQ ID NO: 15763) |
| 74 | AARTHATYYTRGTA (SEQ ID NO: 15764) |
| 74 | A + ARTHAT + YY + TRGT (SEQ ID NO: 15765) |
| 74 | +AARTHAT + YY + TRGT (SEQ ID NO: 15766) |
| 74 | AARTH + AT + YY + TRGT (SEQ ID NO: 15767) |
| 74 | AA + RTHAT + YY + TRGT (SEQ ID NO: 15768) |
| 74 | AARTHAT + YY + TRGT (SEQ ID NO: 15769) |
| 74 | AARTHAT + YY + TRG + T (SEQ ID NO: 15770) |
| 74 | AARTHAT + YY + TRGTA (SEQ ID NO: 15771) |
| 74 | AARTHAT + YY + TR + GT (SEQ ID NO: 15772) |
| 74 | AAARTHATYYTRGTAGCAG (SEQ ID NO: 15773) |
| 74 | AARTHATYYTRGTAGCA (SEQ ID NO: 15774) |
| 74 | AARTHATYYTRGTAG (SEQ ID NO: 15775) |
| 74 | AARTHATYYTRGT (SEQ ID NO: 15776) |
| 74 | AATTATCYTRGTAGC (SEQ ID NO: 15777) |
| 92 | TYCCA + GCAGARACAGGRCA (SEQ ID NO: 15778) |
| 92 | TYCCAGCA + GARACAGGRCA (SEQ ID NO: 15779) |
| 92 | TYCCAG + CAGARACAGGRCA (SEQ ID NO: 15780) |
| 92 | TYCCAGC + AGARACAGGRCA (SEQ ID NO: 15781) |
| 92 | TYCCAGCAGA + RACAGGRCA (SEQ ID NO: 15782) |
| 92 | TYCCAGCAGARACA + GGRCA (SEQ ID NO: 15783) |
| 92 | TYCCAGCAGARACAGG + RCA (SEQ ID NO: 15784) |
| 92 | TYCCAGCAGARA + CAGGRCA (SEQ ID NO: 15785) |
| 92 | TYCCA + GCA + GA + RACAGGRCA (SEQ ID NO: 15786) |
| 92 | TYCC + AGCA + GA + RACAGGRCA (SEQ ID NO: 15787) |
| 92 | TYC + CAGCA + GA + RACAGGRCA (SEQ ID NO: 15788) |
| 92 | TY + CCAGCA + GA + RACAGGRCA (SEQ ID NO: 15789) |
| 92 | TYCCAGCA + GA + RAC + AGGRCA (SEQ ID NO: 15790) |
| 92 | TYCCAGCA + GA + RACAGGRC + A (SEQ ID NO: 15791) |
| 92 | TYCCAGCA + GA + RA + CAGGRCA (SEQ ID NO: 15792) |
| 92 | TYCCAGCA + GA + R + ACAGGRCA (SEQ ID NO: 15793) |
| 92 | ATYCCA + GCAGARACAGGRC (SEQ ID NO: 15794) |
| 92 | AT + YCCAGCAGARACAGGRC (SEQ ID NO: 15795) |
| 92 | ATYCCAG + CAGARACAGGRC (SEQ ID NO: 15796) |
| 92 | ATY + CCAGCAGARACAGGRC (SEQ ID NO: 15797) |
| 92 | ATYCCAGCAG + ARACAGGRC (SEQ ID NO: 15798) |
| 92 | ATYCCAGCAGARA + CAGGRC (SEQ ID NO: 15799) |
| 92 | ATYCCAGCAGARACAG + GRC (SEQ ID NO: 15800) |
| 92 | ATYCCAGCAGA + RACAGGRC (SEQ ID NO: 15801) |
| 92 | ATYCCA + GC + AG + ARACAGGRC (SEQ ID NO: 15802) |
| 92 | ATY + CCAGC + AG + ARACAGGRC (SEQ ID NO: 15803) |
| 92 | AT + YCCAGC + AG + ARACAGGRC (SEQ ID NO: 15804) |
| 92 | ATYC + CAGC + AG + ARACAGGRC (SEQ ID NO: 15805) |
| 92 | ATYCCAGC + AG + ARACAG + GRC (SEQ ID NO: 15806) |
| 92 | ATYCCAGC + AG + ARACA + GGRC (SEQ ID NO: 15807) |
| 92 | ATYCCAGC + AG + ARA + CAGGRC (SEQ ID NO: 15808) |
| 92 | ATYCCAGC + AG + A + RACAGGRC (SEQ ID NO: 15809) |
| 92 | YCCA + GCAGARACAGGRC (SEQ ID NO: 15810) |
| 92 | YCCAGCA + GARACAGGRC (SEQ ID NO: 15811) |
| 92 | YCCAG + CAGARACAGGRC (SEQ ID NO: 15812) |
| 92 | YCCAGC + AGARACAGGRC (SEQ ID NO: 15813) |
| 92 | YCCAGCAGA + RACAGGRC (SEQ ID NO: 15814) |
| 92 | YCCAGCAGARACA + GGRC (SEQ ID NO: 15815) |
| 92 | YCCAGCAGARACAGG + RC (SEQ ID NO: 15816) |
| 92 | YCCAGCAGARA + CAGGRC (SEQ ID NO: 15817) |
| 92 | YCCA + GCA + GA + RACAGGRC (SEQ ID NO: 15818) |
| 92 | YCC + AGCA + GA + RACAGGRC (SEQ ID NO: 15819) |
| 92 | YC + CAGCA + GA + RACAGGRC (SEQ ID NO: 15820) |
| 92 | Y + CCAGCA + GA + RACAGGRC (SEQ ID NO: 15821) |
| 92 | YCCAGCA + GA + RAC + AGGRC (SEQ ID NO: 15822) |
| 92 | YCCAGCA + GA + RACAGGRC (SEQ ID NO: 15823) |
| 92 | YCCAGCA + GA + RA + CAGGRC (SEQ ID NO: 15824) |
| 92 | YCCAGCA + GA + R + ACAGGRC (SEQ ID NO: 15825) |
| 92 | TYCCA + GCAGARACAGGR (SEQ ID NO: 15826) |
| 92 | T + YCCAGCAGARACAGGR (SEQ ID NO: 15827) |
| 92 | TYCCAG + CAGARACAGGR (SEQ ID NO: 15828) |
| 92 | TY + CCAGCAGARACAGGR (SEQ ID NO: 15829) |

TABLE 13-continued

| | |
|---|---|
| 92 | TYCCAGCAG + ARACAGGR (SEQ ID NO: 15830) |
| 92 | TYCCAGCAGARA + CAGGR (SEQ ID NO: 15831) |
| 92 | TYCCAGCAGARACAG + GR (SEQ ID NO: 15832) |
| 92 | TYCCAGCAGA + RACAGGR (SEQ ID NO: 15833) |
| 92 | TYCCA + GC + AG + ARACAGGR (SEQ ID NO: 15834) |
| 92 | TY + CCAGC + AG + ARACAGGR (SEQ ID NO: 15835) |
| 92 | T + YCCAGC + AG + ARACAGGR (SEQ ID NO: 15836) |
| 92 | TYC + CAGC + AG + ARACAGGR (SEQ ID NO: 15837) |
| 92 | TYCCAGC + AG + ARACAG + GR (SEQ ID NO: 15838) |
| 92 | TYCCAGC + AG + ARACA + GGR (SEQ ID NO: 15839) |
| 92 | TYCCAGC + AG + ARA + CAGGR (SEQ ID NO: 15840) |
| 92 | TYCCAGC + AG + A + RACAGGR (SEQ ID NO: 15841) |
| 92 | YCCA + GCAGARACAGG (SEQ ID NO: 15842) |
| 92 | YCCAGCA + GARACAGG (SEQ ID NO: 15843) |
| 92 | YCCAG + CAGARACAGG (SEQ ID NO: 15844) |
| 92 | YCCAGC + AGARACAGG (SEQ ID NO: 15845) |
| 92 | YCCAGCAGA + RACAGG (SEQ ID NO: 15846) |
| 92 | YCCAGCAGARACA + GG (SEQ ID NO: 15847) |
| 92 | YCCAGCAGARACAGG (SEQ ID NO: 15848) |
| 92 | YCCAGCAGARA + CAGG (SEQ ID NO: 15849) |
| 92 | YCCA + GCA + GA + RACAGG (SEQ ID NO: 15850) |
| 92 | YCC + AGCA + GA + RACAGG (SEQ ID NO: 15851) |
| 92 | YC + CAGCA + GA + RACAGG (SEQ ID NO: 15852) |
| 92 | Y + CCAGCA + GA + RACAGG (SEQ ID NO: 15853) |
| 92 | YCCAGCA + GA + RAC + AGG (SEQ ID NO: 15854) |
| 92 | YCCAGCA + GA + RACAGGR (SEQ ID NO: 15855) |
| 92 | YCCAGCA + GA + RA + CAGG (SEQ ID NO: 15856) |
| 92 | YCCAGCA + GA + R + ACAGG (SEQ ID NO: 15857) |
| 92 | TYCCA + GCAGARACAG (SEQ ID NO: 15858) |
| 92 | T + YCCAGCAGARACAG (SEQ ID NO: 15859) |
| 92 | TYCCAG + CAGARACAG (SEQ ID NO: 15860) |
| 92 | TY + CCAGCAGARACAG (SEQ ID NO: 15861) |
| 92 | TYCCAGCAG + ARACAG (SEQ ID NO: 15862) |
| 92 | TYCCAGCAGARA + CAG (SEQ ID NO: 15863) |
| 92 | TYCCAGCAGARACAG (SEQ ID NO: 15864) |
| 92 | TYCCAGCAGA + RACAG (SEQ ID NO: 15865) |
| 92 | TYCCA + GC + AG + ARACAG (SEQ ID NO: 15866) |
| 92 | TY + CCAGC + AG + ARACAG (SEQ ID NO: 15867) |
| 92 | T + YCCAGC + AG + ARACAG (SEQ ID NO: 15868) |
| 92 | TYC + CAGC + AG + ARACAG (SEQ ID NO: 15869) |
| 92 | TYCCAGC + AG + ARACAG (SEQ ID NO: 15870) |
| 92 | TYCCAGC + AG + ARACA + G (SEQ ID NO: 15871) |
| 92 | TYCCAGC + AG + ARA + CAG (SEQ ID NO: 15872) |
| 92 | TYCCAGC + AG + A + RACAG (SEQ ID NO: 15873) |
| 92 | YCCA + GCAGARACA (SEQ ID NO: 15874) |
| 92 | YCCAGCA + GARACA (SEQ ID NO: 15875) |
| 92 | YCCAG + CAGARACA (SEQ ID NO: 15876) |
| 92 | YCCAGC + AGARACA (SEQ ID NO: 15877) |
| 92 | YCCAGCAGA + RACA (SEQ ID NO: 15878) |
| 92 | YCCAGCAGARACA (SEQ ID NO: 15879) |
| 92 | YCCAGCAGARACAG (SEQ ID NO: 15880) |
| 92 | YCCAGCAGARA + CA (SEQ ID NO: 15881) |
| 92 | YCCA + GCA + GA + RACA (SEQ ID NO: 15882) |
| 92 | YCC + AGCA + GA + RACA (SEQ ID NO: 15883) |
| 92 | YC + CAGCA + GA + RACA (SEQ ID NO: 15884) |
| 92 | Y + CCAGCA + GA + RACA (SEQ ID NO: 15885) |
| 92 | YCCAGCA + GA + RAC + A (SEQ ID NO: 15886) |
| 92 | YCCAGCA + GA + RACAG (SEQ ID NO: 15887) |
| 92 | YCCAGCA + GA + RA + CA (SEQ ID NO: 15888) |
| 92 | YCCAGCA + GA + R + ACA (SEQ ID NO: 15889) |
| 92 | TYCCA + GCAGARAC (SEQ ID NO: 15890) |
| 92 | T + YCCAGCAGARAC (SEQ ID NO: 15891) |
| 92 | TYCCAG + CAGARAC (SEQ ID NO: 15892) |
| 92 | TY + CCAGCAGARAC (SEQ ID NO: 15893) |
| 92 | TYCCAGCAG + ARAC (SEQ ID NO: 15894) |
| 92 | TYCCAGCAGARA + C (SEQ ID NO: 15895) |
| 92 | TYCCAGCAGARACA (SEQ ID NO: 15896) |
| 92 | TYCCAGCAGA + RAC (SEQ ID NO: 15897) |
| 92 | TYCCA + GC + AG + ARAC (SEQ ID NO: 15898) |

TABLE 13-continued

| | | |
|---|---|---|
| 92 | TY + CCAGC + AG + ARAC (SEQ ID NO: 15899) | |
| 92 | T + YCCAGC + AG + ARAC (SEQ ID NO: 15900) | |
| 92 | TYC + CAGC + AG + ARAC (SEQ ID NO: 15901) | |
| 92 | TYCCAGC + AG + ARACA (SEQ ID NO: 15902) | |
| 92 | TYCCAGC + AG + ARA + C (SEQ ID NO: 15903) | |
| 92 | TYCCAGC + AG + A + RAC (SEQ ID NO: 15904) | |
| 92 | TYCCAGCAGARACAGGRCA (SEQ ID NO: 15905) | |
| 92 | ATYCCAGCAGARACAGGRC (SEQ ID NO: 15906) | |
| 92 | YCCAGCAGARACAGGRC (SEQ ID NO: 15907) | |
| 92 | TYCCAGCAGARACAGGR (SEQ ID NO: 15908) | |
| 92 | YCCAGCAGARACAGG (SEQ ID NO: 15909) | |
| 92 | YCCAGCAGARACAGGR (SEQ ID NO: 15910) | |
| 92 | TYCCAGCAGARACAG (SEQ ID NO: 15911) | |
| 92 | YCCAGCAGARACA (SEQ ID NO: 15912) | |
| 92 | TYCCAGCAGARAC (SEQ ID NO: 15913) | |
| 92 | CCCAGCAGARACAGG (SEQ ID NO: 15914) | |
| 97 | GG + RCARGARACAGCATAYT (SEQ ID NO: 15915) | |
| 97 | GGRCARG + ARACAGCATAYT (SEQ ID NO: 15916) | |
| 97 | G + GRCARGARACAGCATAYT (SEQ ID NO: 15917) | |
| 97 | GGRCARGA + RACAGCATAYT (SEQ ID NO: 15918) | |
| 97 | GGRCARGARACAG + CATAYT (SEQ ID NO: 15919) | |
| 97 | GGRCARGARACAGCATAY + T (SEQ ID NO: 15920) | |
| 97 | GGRCARGARAC + AGCATAYT (SEQ ID NO: 15921) | |
| 97 | GGRCARGARACA + GCATAYT (SEQ ID NO: 15922) | |
| 97 | GG + RCARGA + RA + CAGCATAYT (SEQ ID NO: 15923) | |
| 97 | GGRC + ARGA + RA + CAGCATAYT (SEQ ID NO: 15924) | |
| 97 | GGR + CARGA + RA + CAGCATAYT (SEQ ID NO: 15925) | |
| 97 | G + GRCARGA + RA + CAGCATAYT (SEQ ID NO: 15926) | |
| 97 | GGRCARGA + RA + CAGCATAY + T (SEQ ID NO: 15927) | |
| 97 | GGRCARGA + RA + CAGCA + TAYT (SEQ ID NO: 15928) | |
| 97 | GGRCARGA + RA + CAGC + ATAYT (SEQ ID NO: 15929) | |
| 97 | GGRCARGA + RA + CA + GCATAYT (SEQ ID NO: 15930) | |
| 97 | G + RCARGARACAGCATAY (SEQ ID NO: 15931) | |
| 97 | GRCARG + ARACAGCATAY (SEQ ID NO: 15932) | |
| 97 | +GRCARGARACAGCATAY (SEQ ID NO: 15933) | |
| 97 | GRCARGA + RACAGCATAY (SEQ ID NO: 15934) | |
| 97 | GRCARGARACAG + CATAY (SEQ ID NO: 15935) | |
| 97 | GRCARGARACAGCATAY (SEQ ID NO: 15936) | |
| 97 | GRCARGARAC + AGCATAY (SEQ ID NO: 15937) | |
| 97 | GRCARGARACA + GCATAY (SEQ ID NO: 15938) | |
| 97 | G + RCARGA + RA + CAGCATAY (SEQ ID NO: 15939) | |
| 97 | GRC + ARGA + RA + CAGCATAY (SEQ ID NO: 15940) | |
| 97 | GR + CARGA + RA + CAGCATAY (SEQ ID NO: 15941) | |
| 97 | +GRCARGA + RA + CAGCATAY (SEQ ID NO: 15942) | |
| 97 | GRCARGA + RA + CAGCATAY (SEQ ID NO: 15943) | |
| 97 | GRCARGA + RA + CAGCA + TAY (SEQ ID NO: 15944) | |
| 97 | GRCARGA + RA + CAGC + ATAY (SEQ ID NO: 15945) | |
| 97 | GRCARGA + RA + CA + GCATAY (SEQ ID NO: 15946) | |
| 97 | G + RCARGARACAGCAT (SEQ ID NO: 15947) | |
| 97 | GRCARG + ARACAGCAT (SEQ ID NO: 15948) | |
| 97 | +GRCARGARACAGCAT (SEQ ID NO: 15949) | |
| 97 | GRCARGA + RACAGCAT (SEQ ID NO: 15950) | |
| 97 | GRCARGARACAG + CAT (SEQ ID NO: 15951) | |
| 97 | GRCARGARACAGCATA (SEQ ID NO: 15952) | |
| 97 | GRCARGARAC + AGCAT (SEQ ID NO: 15953) | |
| 97 | GRCARGARACA + GCAT (SEQ ID NO: 15954) | |
| 97 | G + RCARGA + RA + CAGCAT (SEQ ID NO: 15955) | |
| 97 | GRC + ARGA + RA + CAGCAT (SEQ ID NO: 15956) | |
| 97 | GR + CARGA + RA + CAGCAT (SEQ ID NO: 15957) | |
| 97 | +GRCARGA + RA + CAGCAT (SEQ ID NO: 15958) | |
| 97 | GRCARGA + RA + CAGCATA (SEQ ID NO: 15959) | |
| 97 | GRCARGA + RA + CAGCA + T (SEQ ID NO: 15960) | |
| 97 | GRCARGA + RA + CAGC + AT (SEQ ID NO: 15961) | |
| 97 | GRCARGA + RA + CA + GCAT (SEQ ID NO: 15962) | |
| 97 | G + RCARGARACAGC (SEQ ID NO: 15963) | |
| 97 | GRCARG + ARACAGC (SEQ ID NO: 15964) | |
| 97 | +GRCARGARACAGC (SEQ ID NO: 15965) | |
| 97 | GRCARGA + RACAGC (SEQ ID NO: 15966) | |
| 97 | GRCARGARACAG + C (SEQ ID NO: 15967) | |

TABLE 13-continued

| | |
|---|---|
| 97 | GRCARGARACAGCA (SEQ ID NO: 15968) |
| 97 | GRCARGARAC + AGC (SEQ ID NO: 15969) |
| 97 | GRCARGARACA + GC (SEQ ID NO: 15970) |
| 97 | G + RCARGA + RA + CAGC (SEQ ID NO: 15971) |
| 97 | GRC + ARGA + RA + CAGC (SEQ ID NO: 15972) |
| 97 | GR + CARGA + RA + CAGC (SEQ ID NO: 15973) |
| 97 | +GRCARGA + RA + CAGC (SEQ ID NO: 15974) |
| 97 | GRCARGA + RA + CAGCA (SEQ ID NO: 15975) |
| 97 | GRCARGA + RA + CAGC (SEQ ID NO: 15976) |
| 97 | GRCARGA + RA + CA + GC (SEQ ID NO: 15977) |
| 97 | GGRCARGARACAGCATAYT (SEQ ID NO: 15978) |
| 97 | GRCARGARACAGCATAY (SEQ ID NO: 15979) |
| 97 | GRCARGARACAGCAT (SEQ ID NO: 15980) |
| 97 | GRCARGARACAGC (SEQ ID NO: 15981) |
| 97 | ACAGGAAACWGCATA (SEQ ID NO: 15982) |
| 118 | A + CAGAYAATGGYMSYAAYT (SEQ ID NO: 15983) |
| 118 | ACAGAY + AATGGYMSYAAYT (SEQ ID NO: 15984) |
| 118 | ACA + GAYAATGGYMSYAAYT (SEQ ID NO: 15985) |
| 118 | ACAG + AYAATGGYMSYAAYT (SEQ ID NO: 15986) |
| 118 | ACAGAYAATGGYMSY + AAYT (SEQ ID NO: 15987) |
| 118 | ACAGAYAATGGYMSYA + AYT (SEQ ID NO: 15988) |
| 118 | ACAGAYAATG + GYMSYAAYT (SEQ ID NO: 15989) |
| 118 | ACAGAYAATGG + YMSYAAYT (SEQ ID NO: 15990) |
| 118 | A + CAGAYAA + TG + GYMSYAAYT (SEQ ID NO: 15991) |
| 118 | ACAGAYA + A + TG + GYMSYAAYT (SEQ ID NO: 15992) |
| 118 | AC + AGAYAA + TG + GYMSYAAYT (SEQ ID NO: 15993) |
| 118 | ACAGAY + AA + TG + GYMSYAAYT (SEQ ID NO: 15994) |
| 118 | ACAGAYAA + TG + G + YMSYAAYT (SEQ ID NO: 15995) |
| 118 | ACAGAYAA + TG + GYMS + YAAYT (SEQ ID NO: 15996) |
| 118 | ACAGAYAA + TG + GYMSYAA + YT (SEQ ID NO: 15997) |
| 118 | ACAGAYAA + TG + GYM + SYAAYT (SEQ ID NO: 15998) |
| 118 | +CAGAYAATGGYMSYAAY (SEQ ID NO: 15999) |
| 118 | CAGAY + AATGGYMSYAAY (SEQ ID NO: 16000) |
| 118 | CA + GAYAATGGYMSYAAY (SEQ ID NO: 16001) |
| 118 | CAG + AYAATGGYMSYAAY (SEQ ID NO: 16002) |
| 118 | CAGAYAATGGYMSY + AAY (SEQ ID NO: 16003) |
| 118 | CAGAYAATGGYMSYA + AY (SEQ ID NO: 16004) |
| 118 | CAGAYAATG + GYMSYAAY (SEQ ID NO: 16005) |
| 118 | CAGAYAATGG + YMSYAAY (SEQ ID NO: 16006) |
| 118 | +CAGAYAA + TG + GYMSYAAY (SEQ ID NO: 16007) |
| 118 | CAGAYA + A + TG + GYMSYAAY (SEQ ID NO: 16008) |
| 118 | C + AGAYAA + TG + GYMSYAAY (SEQ ID NO: 16009) |
| 118 | CAGAY + AA + TG + GYMSYAAY (SEQ ID NO: 16010) |
| 118 | CAGAYAA + TG + G + YMSYAAY (SEQ ID NO: 16011) |
| 118 | CAGAYAA + TG + GYMS + YAAY (SEQ ID NO: 16012) |
| 118 | CAGAYAA + TG + GYMSYAA + Y (SEQ ID NO: 16013) |
| 118 | CAGAYAA + TG + GYM + SYAAY (SEQ ID NO: 16014) |
| 118 | +CAGAYAATGGYMSYA (SEQ ID NO: 16015) |
| 118 | CAGAY + AATGGYMSYA (SEQ ID NO: 16016) |
| 118 | CA + GAYAATGGYMSYA (SEQ ID NO: 16017) |
| 118 | CAG + AYAATGGYMSYA (SEQ ID NO: 16018) |
| 118 | CAGAYAATGGYMSY + A (SEQ ID NO: 16019) |
| 118 | CAGAYAATGGYMSYA (SEQ ID NO: 16020) |
| 118 | CAGAYAATG + GYMSYA (SEQ ID NO: 16021) |
| 118 | CAGAYAATGG + YMSYA (SEQ ID NO: 16022) |
| 118 | +CAGAYAA + TG + GYMSYA (SEQ ID NO: 16023) |
| 118 | CAGAYA + A + TG + GYMSYA (SEQ ID NO: 16024) |
| 118 | C + AGAYAA + TG + GYMSYA (SEQ ID NO: 16025) |
| 118 | CAGAY + AA + TG + GYMSYA (SEQ ID NO: 16026) |
| 118 | CAGAYAA + TG + G + YMSYA (SEQ ID NO: 16027) |
| 118 | CAGAYAA + TG + GYMS + YA (SEQ ID NO: 16028) |
| 118 | CAGAYAA + TG + GYMSYAA (SEQ ID NO: 16029) |
| 118 | CAGAYAA + TG + GYM + SYA (SEQ ID NO: 16030) |
| 118 | +CAGAYAATGGYMS (SEQ ID NO: 16031) |
| 118 | CAGAY + AATGGYMS (SEQ ID NO: 16032) |
| 118 | CA + GAYAATGGYMS (SEQ ID NO: 16033) |
| 118 | CAG + AYAATGGYMS (SEQ ID NO: 16034) |
| 118 | CAGAYAATGGYMSY (SEQ ID NO: 16035) |
| 118 | CAGAYAATG + GYMS (SEQ ID NO: 16036) |

TABLE 13-continued

| | |
|---|---|
| 118 | CAGAYAATGG + YMS (SEQ ID NO: 16037) |
| 118 | +CAGAYAA + TG + GYMS (SEQ ID NO: 16038) |
| 118 | CAGAYA + A + TG + GYMS (SEQ ID NO: 16039) |
| 118 | C + AGAYAA + TG + GYMS (SEQ ID NO: 16040) |
| 118 | CAGAY + AA + TG + GYMS (SEQ ID NO: 16041) |
| 118 | CAGAYAA + TG + G + YMS (SEQ ID NO: 16042) |
| 118 | CAGAYAA + TG + GYMS (SEQ ID NO: 16043) |
| 118 | CAGAYAA + TG + GYMSY (SEQ ID NO: 16044) |
| 118 | CAGAYAA + TG + GYM + S (SEQ ID NO: 16045) |
| 118 | ACAGAYAATGGYMSYAAYT (SEQ ID NO: 16046) |
| 118 | CAGAYAATGGYMSYAAY (SEQ ID NO: 16047) |
| 118 | CAGAYAATGGYMSYA (SEQ ID NO: 16048) |
| 118 | CAGAYAATGGYMSYAA (SEQ ID NO: 16049) |
| 118 | CAGAYAATGGYMS (SEQ ID NO: 16050) |
| 118 | AGACAATGGNAGCAA (SEQ ID NO: 16051) |
| 121 | GYMSYAA + YTTYACYAGYRV (SEQ ID NO: 16052) |
| 121 | G + YMSYAAYTTYACYAGYRV (SEQ ID NO: 16053) |
| 121 | GY + MSYAAYTTYACYAGYRV (SEQ ID NO: 16054) |
| 121 | GYMS + YAAYTTYACYAGYRV (SEQ ID NO: 16055) |
| 121 | GYMSYAAYTTYACY + AGYRV (SEQ ID NO: 16056) |
| 121 | GYMSYAAYTTYA + CYAGYRV (SEQ ID NO: 16057) |
| 121 | GYMSYAAYTTY + ACYAGYRV (SEQ ID NO: 16058) |
| 121 | GYMSYAAYTTYACYAGYR + V (SEQ ID NO: 16059) |
| 121 | GYMSYAA + Y + TT + YACYAGYRV (SEQ ID NO: 16060) |
| 121 | GYMS + YAAY + TT + YACYAGYRV (SEQ ID NO: 16061) |
| 121 | G + YMSYAAY + TT + YACYAGYRV (SEQ ID NO: 16062) |
| 121 | GYMSYA + AY + TT + YACYAGYRV (SEQ ID NO: 16063) |
| 121 | GYMSYAAY + TT + YACY + AGYRV (SEQ ID NO: 16064) |
| 121 | GYMSYAAY + TT + YACYAGYR + V (SEQ ID NO: 16065) |
| 121 | GYMSYAAY + TT + YAC + YAGYRV (SEQ ID NO: 16066) |
| 121 | GYMSYAAY + TT + YA + CYAGYRV (SEQ ID NO: 16067) |
| 121 | YMSYAA + YTTYACYAGYR (SEQ ID NO: 16068) |
| 121 | +YMSYAAYTTYACYAGYR (SEQ ID NO: 16069) |
| 121 | Y + MSYAAYTTYACYAGYR (SEQ ID NO: 16070) |
| 121 | YMS + YAAYTTYACYAGYR (SEQ ID NO: 16071) |
| 121 | YMSYAAYTTYACY + AGYR (SEQ ID NO: 16072) |
| 121 | YMSYAAYTTYA + CYAGYR (SEQ ID NO: 16073) |
| 121 | YMSYAAYTTY + ACYAGYR (SEQ ID NO: 16074) |
| 121 | YMSYAAYTTYACYAGYR (SEQ ID NO: 16075) |
| 121 | YMSYAA + Y + TT + YACYAGYR (SEQ ID NO: 16076) |
| 121 | YMS + YAAY + TT + YACYAGYR (SEQ ID NO: 16077) |
| 121 | +YMSYAAY + TT + YACYAGYR (SEQ ID NO: 16078) |
| 121 | YMSYA + AY + TT + YACYAGYR (SEQ ID NO: 16079) |
| 121 | YMSYAAY + TT + YACY + AGYR (SEQ ID NO: 16080) |
| 121 | YMSYAAY + TT + YACYAGYR (SEQ ID NO: 16081) |
| 121 | YMSYAAY + TT + YAC + YAGYR (SEQ ID NO: 16082) |
| 121 | YMSYAAY + TT + YA + CYAGYR (SEQ ID NO: 16083) |
| 121 | YMSYAA + YTTYACYAG (SEQ ID NO: 16084) |
| 121 | +YMSYAAYTTYACYAG (SEQ ID NO: 16085) |
| 121 | Y + MSYAAYTTYACYAG (SEQ ID NO: 16086) |
| 121 | YMS + YAAYTTYACYAG (SEQ ID NO: 16087) |
| 121 | YMSYAAYTTYACY + AG (SEQ ID NO: 16088) |
| 121 | YMSYAAYTTYA + CYAG (SEQ ID NO: 16089) |
| 121 | YMSYAAYTTY + ACYAG (SEQ ID NO: 16090) |
| 121 | YMSYAAYTTYACYAGY (SEQ ID NO: 16091) |
| 121 | YMSYAA + Y + TT + YACYAG (SEQ ID NO: 16092) |
| 121 | YMS + YAAY + TT + YACYAG (SEQ ID NO: 16093) |
| 121 | +YMSYAAY + TT + YACYAG (SEQ ID NO: 16094) |
| 121 | YMSYA + AY + TT + YACYAG (SEQ ID NO: 16095) |
| 121 | YMSYAAY + TT + YACY + AG (SEQ ID NO: 16096) |
| 121 | YMSYAAY + TT + YACYAGY (SEQ ID NO: 16097) |
| 121 | YMSYAAY + TT + YAC + YAG (SEQ ID NO: 16098) |
| 121 | YMSYAAY + TT + YA + CYAG (SEQ ID NO: 16099) |
| 121 | YMSYAA + YTTYACY (SEQ ID NO: 16100) |
| 121 | +YMSYAAYTTYACY (SEQ ID NO: 16101) |
| 121 | Y + MSYAAYTTYACY (SEQ ID NO: 16102) |
| 121 | YMS + YAAYTTYACY (SEQ ID NO: 16103) |
| 121 | YMSYAAYTTYACY (SEQ ID NO: 16104) |
| 121 | YMSYAAYTTYA + CY (SEQ ID NO: 16105) |
| 121 | YMSYAAYTTY + ACY (SEQ ID NO: 16106) |

TABLE 13-continued

| | |
|---|---|
| 121 | YMSYAAYTTYACYA (SEQ ID NO: 16107) |
| 121 | YMSYAA + Y + TT + YACY (SEQ ID NO: 16108) |
| 121 | YMS + YAAY + TT + YACY (SEQ ID NO: 16109) |
| 121 | +YMSYAAY + TT + YACY (SEQ ID NO: 16110) |
| 121 | YMSYA + AY + TT + YACY (SEQ ID NO: 16111) |
| 121 | YMSYAAY + TT + YACY (SEQ ID NO: 16112) |
| 121 | YMSYAAY + TT + YACYA (SEQ ID NO: 16113) |
| 121 | YMSYAAY + TT + YAC + Y (SEQ ID NO: 16114) |
| 121 | YMSYAAY + TT + YA + CY (SEQ ID NO: 16115) |
| 121 | GYMSYAAYTTYACYAGYRV (SEQ ID NO: 16116) |
| 121 | YMSYAAYTTYACYAGYR (SEQ ID NO: 16117) |
| 121 | YMSYAAYTTYACYAG (SEQ ID NO: 16118) |
| 121 | YMSYAAYTTYACY (SEQ ID NO: 16119) |
| 121 | AGCAATTTYACCAGT (SEQ ID NO: 16120) |
| 138 | TCMMRCA + RGAATTTGGVAT (SEQ ID NO: 16121) |
| 138 | TCM + MRCARGAATTTGGVAT (SEQ ID NO: 16122) |
| 138 | TC + MMRCARGAATTTGGVAT (SEQ ID NO: 16123) |
| 138 | TCMMRCAR + GAATTTGGVAT (SEQ ID NO: 16124) |
| 138 | TCMMRCARGAAT + TTGGVAT (SEQ ID NO: 16125) |
| 138 | TCMMRCARGAATTTGGVA + T (SEQ ID NO: 16126) |
| 138 | TCMMRCARGA + ATTGGVAT (SEQ ID NO: 16127) |
| 138 | TCMMRCARGAATTTGGV + AT (SEQ ID NO: 16128) |
| 138 | TC + MMRCAR + GA + ATTTGGVAT (SEQ ID NO: 16129) |
| 138 | TCMMRC + AR + GA + ATTTGGVAT (SEQ ID NO: 16130) |
| 138 | TCM + MRCAR + GA + ATTTGGVAT (SEQ ID NO: 16131) |
| 138 | TCMM + RCAR + GA + ATTTGGVAT (SEQ ID NO: 16132) |
| 138 | TCMMRCAR + GA + ATTTGGVA + T (SEQ ID NO: 16133) |
| 138 | TCMMRCAR + GA + ATT + TGGVAT (SEQ ID NO: 16134) |
| 138 | TCMMRCAR + GA + ATTT + GGVAT (SEQ ID NO: 16135) |
| 138 | TCMMRCAR + GA + A + TTTGGVAT (SEQ ID NO: 16136) |
| 138 | RTC + MMRCARGAATTTGGVA (SEQ ID NO: 16137) |
| 138 | R + TCMMRCARGAATTTGGVA (SEQ ID NO: 16138) |
| 138 | RTCM + MRCARGAATTTGGVA (SEQ ID NO: 16139) |
| 138 | RTCMMRC + ARGAATTTGGVA (SEQ ID NO: 16140) |
| 138 | RTCMMRCARGAATTTGGV + A (SEQ ID NO: 16141) |
| 138 | RTCMMRCARG + AATTTGGVA (SEQ ID NO: 16142) |
| 138 | RTCMMRCARGAAT + TTGGVA (SEQ ID NO: 16143) |
| 138 | RTCMMRCARGA + ATTTGGVA (SEQ ID NO: 16144) |
| 138 | RTCMMRC + A + RG + AATTTGGVA (SEQ ID NO: 16145) |
| 138 | RTCMM + RCA + RG + AATTTGGVA (SEQ ID NO: 16146) |
| 138 | RT + CMMRCA + RG + AATTTGGVA (SEQ ID NO: 16147) |
| 138 | RTC + MMRCA + RG + AATTTGGVA (SEQ ID NO: 16148) |
| 138 | RTCMMRCA + RG + AAT + TTGGVA (SEQ ID NO: 16149) |
| 138 | RTCMMRCA + RG + A + ATTTGGVA (SEQ ID NO: 16150) |
| 138 | RTCMMRCA + RG + AATTTGG + VA (SEQ ID NO: 16151) |
| 138 | RTCMMRCA + RG + AA + TTTGGVA (SEQ ID NO: 16152) |
| 138 | CMMRCA + RGAATTTGGVA (SEQ ID NO: 16153) |
| 138 | CM + MRCARGAATTTGGVA (SEQ ID NO: 16154) |
| 138 | C + MMRCARGAATTTGGVA (SEQ ID NO: 16155) |
| 138 | CMMRCAR + GAATTTGGVA (SEQ ID NO: 16156) |
| 138 | CMMRCARGAAT + TTGGVA (SEQ ID NO: 16157) |
| 138 | CMMRCARGAATTTGGVA (SEQ ID NO: 16158) |
| 138 | CMMRCARGA + ATTTGGVA (SEQ ID NO: 16159) |
| 138 | CMMRCARGAATTTGGV + A (SEQ ID NO: 16160) |
| 138 | C + MMRCAR + GA + ATTTGGVA (SEQ ID NO: 16161) |
| 138 | CMMRC + AR + GA + ATTTGGVA (SEQ ID NO: 16162) |
| 138 | CM + MRCAR + GA + ATTTGGVA (SEQ ID NO: 16163) |
| 138 | CMM + RCAR + GA + ATTTGGVA (SEQ ID NO: 16164) |
| 138 | CMMRCAR + GA + ATTTGGVA (SEQ ID NO: 16165) |
| 138 | CMMRCAR + GA + ATT + TGGVA (SEQ ID NO: 16166) |
| 138 | CMMRCAR + GA + ATTT + GGVA (SEQ ID NO: 16167) |
| 138 | CMMRCAR + GA + A + TTTGGVA (SEQ ID NO: 16168) |
| 138 | TC + MMRCARGAATTTGGV (SEQ ID NO: 16169) |
| 138 | +TCMMRCARGAATTTGGV (SEQ ID NO: 16170) |
| 138 | TCM + MRCARGAATTTGGV (SEQ ID NO: 16171) |
| 138 | TCMMRC + ARGAATTTGGV (SEQ ID NO: 16172) |
| 138 | TCMMRCARGAATTTGGV (SEQ ID NO: 16173) |
| 138 | TCMMRCARG + AATTTGGV (SEQ ID NO: 16174) |

TABLE 13-continued

| 138 | TCMMRCARGAAT + TTGGV (SEQ ID NO: 16175) |
| 138 | TCMMRCARGA + ATTGGV (SEQ ID NO: 16176) |
| 138 | TCMMRC + A + RG + AATTTGGV (SEQ ID NO: 16177) |
| 138 | TCMM + RCA + RG + AATTTGGV (SEQ ID NO: 16178) |
| 138 | T + CMMRCA + RG + AATTTGGV (SEQ ID NO: 16179) |
| 138 | TC + MMRCA + RG + AATTTGGV (SEQ ID NO: 16180) |
| 138 | TCMMRCA + RG + AAT + TTGGV (SEQ ID NO: 16181) |
| 138 | TCMMRCA + RG + A + ATTTGGV (SEQ ID NO: 16182) |
| 138 | TCMMRCA + RG + AATTTGG + V (SEQ ID NO: 16183) |
| 138 | TCMMRCA + RG + AA + TTTGGV (SEQ ID NO: 16184) |
| 138 | CMMRCA + RGAATTTGG (SEQ ID NO: 16185) |
| 138 | CM + MRCARGAATTTGG (SEQ ID NO: 16186) |
| 138 | C + MMRCARGAATTTGG (SEQ ID NO: 16187) |
| 138 | CMMRCAR + GAATTTGG (SEQ ID NO: 16188) |
| 138 | CMMRCARGAAT + TTGG (SEQ ID NO: 16189) |
| 138 | CMMRCARGAATTTGGV (SEQ ID NO: 16190) |
| 138 | CMMRCARGA + ATTTGG (SEQ ID NO: 16191) |
| 138 | C + MMRCAR + GA + ATTTGG (SEQ ID NO: 16192) |
| 138 | CMMRC + AR + GA + ATTTGG (SEQ ID NO: 16193) |
| 138 | CM + MRCAR + GA + ATTTGG (SEQ ID NO: 16194) |
| 138 | CMM + RCAR + GA + ATTTGG (SEQ ID NO: 16195) |
| 138 | CMMRCAR + GA + ATTTGGV (SEQ ID NO: 16196) |
| 138 | CMMRCAR + GA + ATT + TGG (SEQ ID NO: 16197) |
| 138 | CMMRCAR + GA + ATTT + GG (SEQ ID NO: 16198) |
| 138 | CMMRCAR + GA + A + TTTGG (SEQ ID NO: 16199) |
| 138 | TC + MMRCARGAATTTG (SEQ ID NO: 16200) |
| 138 | +TCMMRCARGAATTTG (SEQ ID NO: 16201) |
| 138 | TCM + MRCARGAATTTG (SEQ ID NO: 16202) |
| 138 | TCMMRC + ARGAATTTG (SEQ ID NO: 16203) |
| 138 | TCMMRCARGAATTTGG (SEQ ID NO: 16204) |
| 138 | TCMMRCARG + AATTTG (SEQ ID NO: 16205) |
| 138 | TCMMRCARGAAT + TTG (SEQ ID NO: 16206) |
| 138 | TCMMRCARGA + ATTTG (SEQ ID NO: 16207) |
| 138 | TCMMRC + A + RG + AATTTG (SEQ ID NO: 16208) |
| 138 | TCMM + RCA + RG + AATTTG (SEQ ID NO: 16209) |
| 138 | T + CMMRCA + RG + AATTTG (SEQ ID NO: 16210) |
| 138 | TC + MMRCA + RG + AATTTG (SEQ ID NO: 16211) |
| 138 | TCMMRCA + RG + AAT + TTG (SEQ ID NO: 16212) |
| 138 | TCMMRCA + RG + A + ATTTG (SEQ ID NO: 16213) |
| 138 | TCMMRCA + RG + AATTTGG (SEQ ID NO: 16214) |
| 138 | TCMMRCA + RG + AA + TTTG (SEQ ID NO: 16215) |
| 138 | CMMRCA + RGAATTT (SEQ ID NO: 16216) |
| 138 | CM + MRCARGAATT (SEQ ID NO: 16217) |
| 138 | C + MMRCARGAATT (SEQ ID NO: 16218) |
| 138 | CMMRCAR + GAATTT (SEQ ID NO: 16219) |
| 138 | CMMRCARGAAT + TT (SEQ ID NO: 16220) |
| 138 | CMMRCARGAATTTG (SEQ ID NO: 16221) |
| 138 | CMMRCARGA + ATTT (SEQ ID NO: 16222) |
| 138 | C + MMRCAR + GA + ATTT (SEQ ID NO: 16223) |
| 138 | CMMRC + AR + GA + ATTT (SEQ ID NO: 16224) |
| 138 | CM + MRCAR + GA + ATTT (SEQ ID NO: 16225) |
| 138 | CMM + RCAR + GA + ATTT (SEQ ID NO: 16226) |
| 138 | CMMRCAR + GA + ATTTG (SEQ ID NO: 16227) |
| 138 | CMMRCAR + GA + ATT + T (SEQ ID NO: 16228) |
| 138 | CMMRCAR + GA + ATTT (SEQ ID NO: 16229) |
| 138 | CMMRCAR + GA + A + TTT (SEQ ID NO: 16230) |
| 138 | TC + MMRCARGAATT (SEQ ID NO: 16231) |
| 138 | +TCMMRCARGAATT (SEQ ID NO: 16232) |
| 138 | TCM + MRCARGAATT (SEQ ID NO: 16233) |
| 138 | TCMMRC + ARGAATT (SEQ ID NO: 16234) |
| 138 | TCMMRCARGAATTT (SEQ ID NO: 16235) |
| 138 | TCMMRCARG + AATT (SEQ ID NO: 16236) |
| 138 | TCMMRCARGAAT + T (SEQ ID NO: 16237) |
| 138 | TCMMRCARGA + ATT (SEQ ID NO: 16238) |
| 138 | TCMMRC + A + RG + AATT (SEQ ID NO: 16239) |
| 138 | TCMM + RCA + RG + AATT (SEQ ID NO: 16240) |
| 138 | T + CMMRCA + RG + AATT (SEQ ID NO: 16241) |
| 138 | TC + MMRCA + RG + AATT (SEQ ID NO: 16242) |
| 138 | TCMMRCA + RG + AAT + T (SEQ ID NO: 16243) |

TABLE 13-continued

| | |
|---|---|
| 138 | TCMMRCA + RG + A + ATT (SEQ ID NO: 16244) |
| 138 | TCMMRCA + RG + AATTT (SEQ ID NO: 16245) |
| 138 | TCMMRCA + RG + AA + TT (SEQ ID NO: 16246) |
| 138 | TCMMRCARGAATTTGGVAT (SEQ ID NO: 16247) |
| 138 | RTCMMRCARGAATTTGGVA (SEQ ID NO: 16248) |
| 138 | CMMRCARGAATTTGGVA (SEQ ID NO: 16249) |
| 138 | TCMMRCARGAATTTGGV (SEQ ID NO: 16250) |
| 138 | CMMRCARGAATTTGG (SEQ ID NO: 16251) |
| 138 | TCMMRCARGAATTTG (SEQ ID NO: 16252) |
| 138 | CMMRCARGAATTT (SEQ ID NO: 16253) |
| 138 | TCMMRCARGAATT (SEQ ID NO: 16254) |
| 138 | AAACAGGARTTTGGA (SEQ ID NO: 16255) |
| 140 | ARGAA + TTTGGVATYCCCTA (SEQ ID NO: 16256) |
| 140 | ARG + AATTTGGVATYCCCTA (SEQ ID NO: 16257) |
| 140 | ARGAAT + TTGGVATYCCCTA (SEQ ID NO: 16258) |
| 140 | ARGAATTT + GGVATYCCCTA (SEQ ID NO: 16259) |
| 140 | ARGAATTTGGVATYCC + CTA (SEQ ID NO: 16260) |
| 140 | ARGAATTTGGVATYC + CCTA (SEQ ID NO: 16261) |
| 140 | ARGAATTTGGVATYCCCT + A (SEQ ID NO: 16262) |
| 140 | ARGAATTTGGVA + TYCCCTA (SEQ ID NO: 16263) |
| 140 | ARGA + ATTT + GG + VATYCCCTA (SEQ ID NO: 16264) |
| 140 | ARG + AATTT + GG + VATYCCCTA (SEQ ID NO: 16265) |
| 140 | ARGAATT + T + GG + VATYCCCTA (SEQ ID NO: 16266) |
| 140 | A + RGAATTT + GG + VATYCCCTA (SEQ ID NO: 16267) |
| 140 | ARGAATTT + GG + VATY + CCCTA (SEQ ID NO: 16268) |
| 140 | ARGAATTT + GG + VATYCCCT + A (SEQ ID NO: 16269) |
| 140 | ARGAATTT + GG + VATYC + CCTA (SEQ ID NO: 16270) |
| 140 | ARGAATTT + GG + VAT + YCCCTA (SEQ ID NO: 16271) |
| 140 | CARG + AATTTGGVATYCCCT (SEQ ID NO: 16272) |
| 140 | CARGAATT + TGGVATYCCCT (SEQ ID NO: 16273) |
| 140 | CA + RGAATTTGGVATYCCCT (SEQ ID NO: 16274) |
| 140 | CARGAAT + TTGGVATYCCCT (SEQ ID NO: 16275) |
| 140 | CARGAATTTGGVAT + YCCCT (SEQ ID NO: 16276) |
| 140 | CARGAATTTGGVATY + CCCT (SEQ ID NO: 16277) |
| 140 | CARGAATTTGGVATYC + CCT (SEQ ID NO: 16278) |
| 140 | CARGAATTTGGV + ATYCCCT (SEQ ID NO: 16279) |
| 140 | CAR + GAATT + TG + GVATYCCCT (SEQ ID NO: 16280) |
| 140 | CA + RGAATT + TG + GVATYCCCT (SEQ ID NO: 16281) |
| 140 | C + ARGAATT + TG + GVATYCCCT (SEQ ID NO: 16282) |
| 140 | CARGAAT + T + TG + GVATYCCCT (SEQ ID NO: 16283) |
| 140 | CARGAATT + TG + GV + ATYCCCT (SEQ ID NO: 16284) |
| 140 | CARGAATT + TG + GVATY + CCCT (SEQ ID NO: 16285) |
| 140 | CARGAATT + TG + GVA + TYCCCT (SEQ ID NO: 16286) |
| 140 | CARGAATT + TG + GVATYCC + CT (SEQ ID NO: 16287) |
| 140 | CARGAA + TTTGGVATYCCCT (SEQ ID NO: 16288) |
| 140 | CAR + GAATTTGGVATYCCCT (SEQ ID NO: 16289) |
| 140 | C + ARGAATTTGGVATYCCCT (SEQ ID NO: 16290) |
| 140 | CARGAATTTGGVATYCCC + T (SEQ ID NO: 16291) |
| 140 | CARGAATTTG + GVATYCCCT (SEQ ID NO: 16292) |
| 140 | CARG + AATT + TG + GVATYCCCT (SEQ ID NO: 16293) |
| 140 | CARGA + ATT + TG + GVATYCCCT (SEQ ID NO: 16294) |
| 140 | CARGAATT + TG + G + VATYCCCT (SEQ ID NO: 16295) |
| 140 | CARGAATT + TG + GVAT + YCCCT (SEQ ID NO: 16296) |
| 140 | RGAA + TTTGGVATYCCCT (SEQ ID NO: 16297) |
| 140 | RG + AATTTGGVATYCCCT (SEQ ID NO: 16298) |
| 140 | RGAAT + TTGGVATYCCCT (SEQ ID NO: 16299) |
| 140 | RGAATTT + GGVATYCCCT (SEQ ID NO: 16300) |
| 140 | RGAATTTGGVATYCC + CT (SEQ ID NO: 16301) |
| 140 | RGAATTTGGVATYC + CCT (SEQ ID NO: 16302) |
| 140 | RGAATTTGGVATYCCCT (SEQ ID NO: 16303) |
| 140 | RGAATTTGGVA + TYCCCT (SEQ ID NO: 16304) |
| 140 | RGA + ATTT + GG + VATYCCCT (SEQ ID NO: 16305) |
| 140 | RG + AATTT + GG + VATYCCCT (SEQ ID NO: 16306) |
| 140 | RGAATT + T + GG + VATYCCCT (SEQ ID NO: 16307) |
| 140 | +RGAATTT + GG + VATYCCCT (SEQ ID NO: 16308) |
| 140 | RGAATTT + GG + VATY + CCCT (SEQ ID NO: 16309) |
| 140 | RGAATTT + GG + VATYCCCT (SEQ ID NO: 16310) |

TABLE 13-continued

| | |
|---|---|
| 140 | RGAATTT + GG + VATYC + CCT (SEQ ID NO: 16311) |
| 140 | RGAATTT + GG + VAT + YCCCT (SEQ ID NO: 16312) |
| 140 | ARG + AATTTGGVATYCCC (SEQ ID NO: 16313) |
| 140 | ARGAATT + TGGVATYCCC (SEQ ID NO: 16314) |
| 140 | A + RGAATTTGGVATYCCC (SEQ ID NO: 16315) |
| 140 | ARGAAT + TTGGVATYCCC (SEQ ID NO: 16316) |
| 140 | ARGAATTTGGVAT + YCCC (SEQ ID NO: 16317) |
| 140 | ARGAATTTGGVATY + CCC (SEQ ID NO: 16318) |
| 140 | ARGAATTTGGVATYC + CC (SEQ ID NO: 16319) |
| 140 | ARGAATTTGGV + ATYCCC (SEQ ID NO: 16320) |
| 140 | AR + GAATT + TG + GVATYCCC (SEQ ID NO: 16321) |
| 140 | A + RGAATT + TG + GVATYCCC (SEQ ID NO: 16322) |
| 140 | +ARGAATT + TG + GVATYCCC (SEQ ID NO: 16323) |
| 140 | ARGAAT + T + TG + GVATYCCC (SEQ ID NO: 16324) |
| 140 | ARGAATT + TG + GV + ATYCCC (SEQ ID NO: 16325) |
| 140 | ARGAATT + TG + GVATY + CCC (SEQ ID NO: 16326) |
| 140 | ARGAATT + TG + GVA + TYCCC (SEQ ID NO: 16327) |
| 140 | ARGAATT + TG + GVATYCC + C (SEQ ID NO: 16328) |
| 140 | ARGAA + TTTGGVATYCCC (SEQ ID NO: 16329) |
| 140 | AR + GAATTTGGVATYCCC (SEQ ID NO: 16330) |
| 140 | +ARGAATTTGGVATYCCC (SEQ ID NO: 16331) |
| 140 | ARGAATTTGGVATYCCC (SEQ ID NO: 16332) |
| 140 | ARGAATTTG + GVATYCCC (SEQ ID NO: 16333) |
| 140 | ARG + AATT + TG + GVATYCCC (SEQ ID NO: 16334) |
| 140 | ARGA + ATT + TG + GVATYCCC (SEQ ID NO: 16335) |
| 140 | ARGAATT + TG + G + VATYCCC (SEQ ID NO: 16336) |
| 140 | ARGAATT + TG + GVAT + YCCC (SEQ ID NO: 16337) |
| 140 | RGAA + TTTGGVATYCC (SEQ ID NO: 16338) |
| 140 | RG + AATTTGGVATYCC (SEQ ID NO: 16339) |
| 140 | RGAAT + TTGGVATYCC (SEQ ID NO: 16340) |
| 140 | RGAATTT + GGVATYCC (SEQ ID NO: 16341) |
| 140 | RGAATTTGGVATYCC (SEQ ID NO: 16342) |
| 140 | RGAATTTGGVATYC + C (SEQ ID NO: 16343) |
| 140 | RGAATTTGGVATYCCC (SEQ ID NO: 16344) |
| 140 | RGAATTTGGVA + TYCC (SEQ ID NO: 16345) |
| 140 | RGA + ATTT + GG + VATYCC (SEQ ID NO: 16346) |
| 140 | RG + AATTT + GG + VATYCC (SEQ ID NO: 16347) |
| 140 | RGAATT + T + GG + VATYCC (SEQ ID NO: 16348) |
| 140 | +RGAATTT + GG + VATYCC (SEQ ID NO: 16349) |
| 140 | RGAATTT + GG + VATY + CC (SEQ ID NO: 16350) |
| 140 | RGAATTT + GG + VATYCCC (SEQ ID NO: 16351) |
| 140 | RGAATTT + GG + VATYC + C (SEQ ID NO: 16352) |
| 140 | RGAATTT + GG + VAT + YCC (SEQ ID NO: 16353) |
| 140 | ARG + AATTTGGVATYC (SEQ ID NO: 16354) |
| 140 | ARGAATT + TGGVATYC (SEQ ID NO: 16355) |
| 140 | A + RGAATTTGGVATYC (SEQ ID NO: 16356) |
| 140 | ARGAAT + TTGGVATYC (SEQ ID NO: 16357) |
| 140 | ARGAATTTGGVAT + YC (SEQ ID NO: 16358) |
| 140 | ARGAATTTGGVATY + C (SEQ ID NO: 16359) |
| 140 | ARGAATTTGGVATYC (SEQ ID NO: 16360) |
| 140 | ARGAATTTGGV + ATYC (SEQ ID NO: 16361) |
| 140 | AR + GAATT + TG + GVATYC (SEQ ID NO: 16362) |
| 140 | A + RGAATT + TG + GVATYC (SEQ ID NO: 16363) |
| 140 | +ARGAATT + TG + GVATYC (SEQ ID NO: 16364) |
| 140 | ARGAAT + T + TG + GVATYC (SEQ ID NO: 16365) |
| 140 | ARGAATT + TG + GV + ATYC (SEQ ID NO: 16366) |
| 140 | ARGAATT + TG + GVATY + C (SEQ ID NO: 16367) |
| 140 | ARGAATT + TG + GVA + TYC (SEQ ID NO: 16368) |
| 140 | ARGAATT + TG + GVATYCC (SEQ ID NO: 16369) |
| 140 | ARGAA + TTTGGVATYC (SEQ ID NO: 16370) |
| 140 | AR + GAATTTGGVATYC (SEQ ID NO: 16371) |
| 140 | +ARGAATTTGGVATYC (SEQ ID NO: 16372) |
| 140 | ARGAATTTGGVATYCC (SEQ ID NO: 16373) |
| 140 | ARGAATTTG + GVATYC (SEQ ID NO: 16374) |
| 140 | ARG + AATT + TG + GVATYC (SEQ ID NO: 16375) |
| 140 | ARGA + ATT + TG + GVATYC (SEQ ID NO: 16376) |

TABLE 13-continued

| | |
|---|---|
| 140 | ARGAATT + TG + G + VATYC (SEQ ID NO: 16377) |
| 140 | ARGAATT + TG + GVAT + YC (SEQ ID NO: 16378) |
| 140 | RGAA + TTTGGVATY (SEQ ID NO: 16379) |
| 140 | RG + AATTTGGVATY (SEQ ID NO: 16380) |
| 140 | RGAAT + TTGGVATY (SEQ ID NO: 16381) |
| 140 | RGAATTT + GGVATY (SEQ ID NO: 16382) |
| 140 | RGAATTTGGVATYC (SEQ ID NO: 16383) |
| 140 | RGAATTTGGVA + TY (SEQ ID NO: 16384) |
| 140 | RGA + ATTT + GG + VATY (SEQ ID NO: 16385) |
| 140 | RG + AATTT + GG + VATY (SEQ ID NO: 16386) |
| 140 | RGAATT + T + GG + VATY (SEQ ID NO: 16387) |
| 140 | +RGAATTT + GG + VATY (SEQ ID NO: 16388) |
| 140 | RGAATTT + GG + VATY (SEQ ID NO: 16389) |
| 140 | RGAATTT + GG + VATYC (SEQ ID NO: 16390) |
| 140 | RGAATTT + GG + VAT + Y (SEQ ID NO: 16391) |
| 140 | ARG + AATTTGGVAT (SEQ ID NO: 16392) |
| 140 | ARGAATT + TGGVAT (SEQ ID NO: 16393) |
| 140 | A + RGAATTTGGVAT (SEQ ID NO: 16394) |
| 140 | ARGAAT + TTGGVAT (SEQ ID NO: 16395) |
| 140 | ARGAATTTGGVAT (SEQ ID NO: 16396) |
| 140 | ARGAATTTGGVATY (SEQ ID NO: 16397) |
| 140 | ARGAATTTGGV + AT (SEQ ID NO: 16398) |
| 140 | AR + GAATT + TG + GVAT (SEQ ID NO: 16399) |
| 140 | A + RGAATT + TG + GVAT (SEQ ID NO: 16400) |
| 140 | +ARGAATT + TG + GVAT (SEQ ID NO: 16401) |
| 140 | ARGAAT + T + TG + GVAT (SEQ ID NO: 16402) |
| 140 | ARGAATT + TG + GV + AT (SEQ ID NO: 16403) |
| 140 | ARGAATT + TG + GVATY (SEQ ID NO: 16404) |
| 140 | ARGAATT + TG + GVA + T (SEQ ID NO: 16405) |
| 140 | ARGAA + TTTGGVAT (SEQ ID NO: 16406) |
| 140 | AR + GAATTTGGVAT (SEQ ID NO: 16407) |
| 140 | +ARGAATTTGGVAT (SEQ ID NO: 16408) |
| 140 | ARGAATTTG + GVAT (SEQ ID NO: 16409) |
| 140 | ARG + AATT + TG + GVAT (SEQ ID NO: 16410) |
| 140 | ARGA + ATT + TG + GVAT (SEQ ID NO: 16411) |
| 140 | ARGAATT + TG + G + VAT (SEQ ID NO: 16412) |
| 140 | ARGAATT + TG + GVAT (SEQ ID NO: 16413) |
| 140 | ARGAATTTGGVATYCCCTA (SEQ ID NO: 16414) |
| 140 | CARGAATTTGGVATYCCCT (SEQ ID NO: 16415) |
| 140 | RGAATTTGGVATYCCCT (SEQ ID NO: 16416) |
| 140 | ARGAATTTGGVATYCCC (SEQ ID NO: 16417) |
| 140 | RGAATTTGGVATYCC (SEQ ID NO: 16418) |
| 140 | ARGAATTTGGVATYC (SEQ ID NO: 16419) |
| 140 | RGAATTTGGVATY (SEQ ID NO: 16420) |
| 140 | ARGAATTTGGVAT (SEQ ID NO: 16421) |
| 140 | AATTTGGNATTCCCT (SEQ ID NO: 16422) |
| 143 | GVAT + YCCCTACAATCCCCA (SEQ ID NO: 16423) |
| 143 | GV + ATYCCCTACAATCCCCA (SEQ ID NO: 16424) |
| 143 | GVATY + CCCTACAATCCCCA (SEQ ID NO: 16425) |
| 143 | GVATYCCC + TACAATCCCCA (SEQ ID NO: 16426) |
| 143 | GVATYCCCTACAATC + CCCA (SEQ ID NO: 16427) |
| 143 | GVATYCCCTACAATCC + CCA (SEQ ID NO: 16428) |
| 143 | GVATYCCCTAC + AATCCCCA (SEQ ID NO: 16429) |
| 143 | GVATYCCCTACAAT + CCCCA (SEQ ID NO: 16430) |
| 143 | GV + ATYCCC + TA + CAATCCCCA (SEQ ID NO: 16431) |
| 143 | GVATYC + CC + TA + CAATCCCCA (SEQ ID NO: 16432) |
| 143 | G + VATYCCC + TA + CAATCCCCA (SEQ ID NO: 16433) |
| 143 | GVATY + CCC + TA + CAATCCCCA (SEQ ID NO: 16434) |
| 143 | GVATYCCC + TA + CAATCCC + CA (SEQ ID NO: 16435) |
| 143 | GVATYCCC + TA + CAA + TCCCCA (SEQ ID NO: 16436) |
| 143 | GVATYCCC + TA + CAATCCCC + A (SEQ ID NO: 16437) |
| 143 | GVATYCCC + TA + C + AATCCCCA (SEQ ID NO: 16438) |
| 143 | G + GVATYCCCTACAATCCCC (SEQ ID NO: 16439) |
| 143 | GG + VATYCCCTACAATCCCC (SEQ ID NO: 16440) |
| 143 | GGVATYCC + CTACAATCCCC (SEQ ID NO: 16441) |
| 143 | GGVA + TYCCCTACAATCCCC (SEQ ID NO: 16442) |
| 143 | GGVATYCCCTACAA + TCCCC (SEQ ID NO: 16443) |
| 143 | GGVATYCCCTACAATCCC + C (SEQ ID NO: 16444) |
| 143 | GGVATYCCCTA + CAATCCCC (SEQ ID NO: 16445) |
| 143 | GGVATYCCCTAC + AATCCCC (SEQ ID NO: 16446) |
| 143 | GGVATY + CC + CT + ACAATCCCC (SEQ ID NO: 16447) |
| 143 | GGVAT + YCC + CT + ACAATCCCC (SEQ ID NO: 16448) |
| 143 | GG + VATYCC + CT + ACAATCCCC (SEQ ID NO: 16449) |

TABLE 13-continued

| | |
|---|---|
| 143 | GGVA + TYCC + CT + ACAATCCCC (SEQ ID NO: 16450) |
| 143 | GGVATYCC + CT + ACAATC + CCC (SEQ ID NO: 16451) |
| 143 | GGVATYCC + CT + A + CAATCCCC (SEQ ID NO: 16452) |
| 143 | GGVATYCC + CT + ACAA + TCCCC (SEQ ID NO: 16453) |
| 143 | GGVATYCC + CT + ACAATCCC + C (SEQ ID NO: 16454) |
| 143 | G + VATYCCCTACAATCCCCA (SEQ ID NO: 16455) |
| 143 | GVA + TYCCCTACAATCCCCA (SEQ ID NO: 16456) |
| 143 | GVATYCCCTACAATCCCC + A (SEQ ID NO: 16457) |
| 143 | GVATYCCCTACA + ATCCCCA (SEQ ID NO: 16458) |
| 143 | GVATYCC + C + TA + CAATCCCCA (SEQ ID NO: 16459) |
| 143 | GVATYCCC + TA + CAAT + CCCCA (SEQ ID NO: 16460) |
| 143 | GVATYCCC + TA + CA + ATCCCCA (SEQ ID NO: 16461) |
| 143 | VAT + YCCCTACAATCCCC (SEQ ID NO: 16462) |
| 143 | V + ATYCCCTACAATCCCC (SEQ ID NO: 16463) |
| 143 | VATY + CCCTACAATCCCC (SEQ ID NO: 16464) |
| 143 | VATYCCC + TACAATCCCC (SEQ ID NO: 16465) |
| 143 | VATYCCCTACAAT + CCC (SEQ ID NO: 16466) |
| 143 | VATYCCCTACAATCC + CC (SEQ ID NO: 16467) |
| 143 | VATYCCCTAC + AATCCC (SEQ ID NO: 16468) |
| 143 | VATYCCCTACAAT + CCCC (SEQ ID NO: 16469) |
| 143 | V + ATYCCC + TA + CAATCCCC (SEQ ID NO: 16470) |
| 143 | VATYC + CC + TA + CAATCCCC (SEQ ID NO: 16471) |
| 143 | +VATYCCC + TA + CAATCCCC (SEQ ID NO: 16472) |
| 143 | VATY + CCC + TA + CAATCCCC (SEQ ID NO: 16473) |
| 143 | VATYCCC + TA + CAATCCC + C (SEQ ID NO: 16474) |
| 143 | VATYCCC + TA + CAA + TCCCC (SEQ ID NO: 16475) |
| 143 | VATYCCC + TA + CAATCCCC (SEQ ID NO: 16476) |
| 143 | VATYCCC + TA + C + AATCCC (SEQ ID NO: 16477) |
| 143 | +GVATYCCCTACAATCCC (SEQ ID NO: 16478) |
| 143 | G + VATYCCCTACAATCCC (SEQ ID NO: 16479) |
| 143 | GVATYCC + CTACAATCCC (SEQ ID NO: 16480) |
| 143 | GVA + TYCCCTACAATCCC (SEQ ID NO: 16481) |
| 143 | GVATYCCCTACAA + TCCC (SEQ ID NO: 16482) |
| 143 | GVATYCCCTACAATCCC (SEQ ID NO: 16483) |
| 143 | GVATYCCCTA + CAATCCC (SEQ ID NO: 16484) |
| 143 | GVATYCCCTAC + AATCCC (SEQ ID NO: 16485) |
| 143 | GVATY + CC + CT + ACAATCCC (SEQ ID NO: 16486) |
| 143 | GVAT + YCC + CT + ACAATCCC (SEQ ID NO: 16487) |
| 143 | G + VATYCC + CT + ACAATCCC (SEQ ID NO: 16488) |
| 143 | GVA + TYCC + CT + ACAATCCC (SEQ ID NO: 16489) |
| 143 | GVATYCC + CT + ACAATC + CC (SEQ ID NO: 16490) |
| 143 | GVATYCC + CT + A + CAATCCC (SEQ ID NO: 16491) |
| 143 | GVATYCC + CT + ACAA + TCCC (SEQ ID NO: 16492) |
| 143 | GVATYCC + CT + ACAATCCC (SEQ ID NO: 16493) |
| 143 | +VATYCCCTACAATCCC (SEQ ID NO: 16494) |
| 143 | VA + TYCCCTACAATCCCC (SEQ ID NO: 16495) |
| 143 | VATYCCCTACAATCCCC (SEQ ID NO: 16496) |
| 143 | VATYCCCTACA + ATCCCC (SEQ ID NO: 16497) |
| 143 | VATYCC + C + TA + CAATCCCC (SEQ ID NO: 16498) |
| 143 | VATYCCC + TA + CAAT + CCCC (SEQ ID NO: 16499) |
| 143 | VATYCCC + TA + CA + ATCCCC (SEQ ID NO: 16500) |
| 143 | VAT + YCCCTACAATCC (SEQ ID NO: 16501) |
| 143 | V + ATYCCCTACAATCC (SEQ ID NO: 16502) |
| 143 | VATY + CCCTACAATCC (SEQ ID NO: 16503) |
| 143 | VATYCCC + TACAATCC (SEQ ID NO: 16504) |
| 143 | VATYCCCTACAATC + C (SEQ ID NO: 16505) |
| 143 | VATYCCCTACAATCC (SEQ ID NO: 16506) |
| 143 | VATYCCCTAC + AATCC (SEQ ID NO: 16507) |
| 143 | VATYCCCTACAAT + CC (SEQ ID NO: 16508) |
| 143 | V + ATYCCC + TA + CAATCC (SEQ ID NO: 16509) |
| 143 | VATYC + CC + TA + CAATCC (SEQ ID NO: 16510) |
| 143 | +VATYCCC + TA + CAATCC (SEQ ID NO: 16511) |
| 143 | VATY + CCC + TA + CAATCC (SEQ ID NO: 16512) |
| 143 | VATYCCC + TA + CAATCCC (SEQ ID NO: 16513) |
| 143 | VATYCCC + TA + CAA + TCC (SEQ ID NO: 16514) |
| 143 | VATYCCC + TA + C + AATCC (SEQ ID NO: 16515) |
| 143 | +GVATYCCCTACAATC (SEQ ID NO: 16516) |
| 143 | G + VATYCCCTACAATC (SEQ ID NO: 16517) |

TABLE 13-continued

| | |
|---|---|
| 143 | GVATYCC + CTACAATC (SEQ ID NO: 16518) |
| 143 | GVA + TYCCCTACAATC (SEQ ID NO: 16519) |
| 143 | GVATYCCCTACAA + TC (SEQ ID NO: 16520) |
| 143 | GVATYCCCTACAATCC (SEQ ID NO: 16521) |
| 143 | GVATYCCCTA + CAATC (SEQ ID NO: 16522) |
| 143 | GVATYCCCTAC + AATC (SEQ ID NO: 16523) |
| 143 | GVATY + CC + CT + ACAATC (SEQ ID NO: 16524) |
| 143 | GVAT + YCC + CT + ACAATC (SEQ ID NO: 16525) |
| 143 | G + VATYCC + CT + ACAATC (SEQ ID NO: 16526) |
| 143 | GVA + TYCC + CT + ACAATC (SEQ ID NO: 16527) |
| 143 | GVATYCC + CT + ACAATC (SEQ ID NO: 16528) |
| 143 | GVATYCC + CT + A + CAATC (SEQ ID NO: 16529) |
| 143 | GVATYCC + CT + ACAA + TC (SEQ ID NO: 16530) |
| 143 | GVATYCC + CT + ACAATCC (SEQ ID NO: 16531) |
| 143 | +VATYCCCTACAATCC (SEQ ID NO: 16532) |
| 143 | VA + TYCCCTACAATCC (SEQ ID NO: 16533) |
| 143 | VATYCCCTACAATCCC (SEQ ID NO: 16534) |
| 143 | VATYCCCTACA + ATCC (SEQ ID NO: 16535) |
| 143 | VATYCC + C + TA + CAATCC (SEQ ID NO: 16536) |
| 143 | VATYCCC + TA + CAAT + CC (SEQ ID NO: 16537) |
| 143 | VATYCCC + TA + CA + ATCC (SEQ ID NO: 16538) |
| 143 | VAT + YCCCTACAAT (SEQ ID NO: 16539) |
| 143 | V + ATYCCCTACAAT (SEQ ID NO: 16540) |
| 143 | VATY + CCCTACAAT (SEQ ID NO: 16541) |
| 143 | VATYCCC + TACAAT (SEQ ID NO: 16542) |
| 143 | VATYCCCTACAATC (SEQ ID NO: 16543) |
| 143 | VATYCCCTAC + AAT (SEQ ID NO: 16544) |
| 143 | VATYCCCTACAAT (SEQ ID NO: 16545) |
| 143 | V + ATYCCC + TA + CAAT (SEQ ID NO: 16546) |
| 143 | VATYC + CC + TA + CAAT (SEQ ID NO: 16547) |
| 143 | +VATYCCC + TA + CAAT (SEQ ID NO: 16548) |
| 143 | VATY + CCC + TA + CAAT (SEQ ID NO: 16549) |
| 143 | VATYCCC + TA + CAATC (SEQ ID NO: 16550) |
| 143 | VATYCCC + TA + CAA + T (SEQ ID NO: 16551) |
| 143 | VATYCCC + TA + C + AAT (SEQ ID NO: 16552) |
| 143 | +GVATYCCCTACAA (SEQ ID NO: 16553) |
| 143 | G + VATYCCCTACAA (SEQ ID NO: 16554) |
| 143 | GVATYCC + CTACAA (SEQ ID NO: 16555) |
| 143 | GVA + TYCCCTACAA (SEQ ID NO: 16556) |
| 143 | GVATYCCCTACAA (SEQ ID NO: 16557) |
| 143 | GVATYCCCTACAAT (SEQ ID NO: 16558) |
| 143 | GVATYCCCTA + CAA (SEQ ID NO: 16559) |
| 143 | GVATYCCCTAC + AA (SEQ ID NO: 16560) |
| 143 | GVATY + CC + CT + ACAA (SEQ ID NO: 16561) |
| 143 | GVAT + YCC + CT + ACAA (SEQ ID NO: 16562) |
| 143 | G + VATYCC + CT + ACAA (SEQ ID NO: 16563) |
| 143 | GVA + TYCC + CT + ACAA (SEQ ID NO: 16564) |
| 143 | GVATYCC + CT + ACAAT (SEQ ID NO: 16565) |
| 143 | GVATYCC + CT + A + CAA (SEQ ID NO: 16566) |
| 143 | GVATYCC + CT + ACAA (SEQ ID NO: 16567) |
| 143 | +VATYCCCTACAAT (SEQ ID NO: 16568) |
| 143 | VA + TYCCCTACAAT (SEQ ID NO: 16569) |
| 143 | VATYCCCTACA + AT (SEQ ID NO: 16570) |
| 143 | VATYCC + C + TA + CAAT (SEQ ID NO: 16571) |
| 143 | VATYCCC + TA + CAAT (SEQ ID NO: 16572) |
| 143 | VATYCCC + TA + CA + AT (SEQ ID NO: 16573) |
| 143 | GVATYCCCTACAATCCCCA (SEQ ID NO: 16574) |
| 143 | GGVATYCCCTACAATCCCC (SEQ ID NO: 16575) |
| 143 | VATYCCCTACAATCCCC (SEQ ID NO: 16576) |
| 143 | GVATYCCCTACAATCCC (SEQ ID NO: 16577) |
| 143 | VATYCCCTACAATCC (SEQ ID NO: 16578) |
| 143 | GVATYCCCTACAATC (SEQ ID NO: 16579) |
| 143 | VATYCCCTACAAT (SEQ ID NO: 16580) |
| 143 | GVATYCCCTACAA (SEQ ID NO: 16581) |
| 143 | ATTCCCTAYAATCCC (SEQ ID NO: 16582) |
| 145 | C + CCTACAATCCCAAAGYC (SEQ ID NO: 16583) |
| 145 | CC + CTACAATCCCAAAGYC (SEQ ID NO: 16584) |
| 145 | CCCTACAA + TCCCAAAGYC (SEQ ID NO: 16585) |
| 145 | CCC + TACAATCCCAAAGYC (SEQ ID NO: 16586) |
| 145 | CCCTACAATCCCAAAGY + C (SEQ ID NO: 16587) |
| 145 | CCCTACAATCCCA + AAGYC (SEQ ID NO: 16588) |
| 145 | CCCTACAATCCCC + AAAGYC (SEQ ID NO: 16589) |
| 145 | CCCTACAATCCCAA + AGYC (SEQ ID NO: 16590) |
| 145 | CC + CTACAA + TC + CCCAAAGYC (SEQ ID NO: 16591) |
| 145 | CCC + TACAA + TC + CCCAAAGYC (SEQ ID NO: 16592) |
| 145 | CCCTACA + A + TC + CCCAAAGYC (SEQ ID NO: 16593) |
| 145 | CCCTA + CAA + TC + CCCAAAGYC (SEQ ID NO: 16594) |

TABLE 13-continued

| | |
|---|---|
| 145 | CCCTACAA + TC + CCCAA + AGYC (SEQ ID NO: 16595) |
| 145 | CCCTACAA + TC + C + CCAAAGYC (SEQ ID NO: 16596) |
| 145 | CCCTACAA + TC + CCCA + AAGYC (SEQ ID NO: 16597) |
| 145 | CCCTACAA + TC + CCCAAAGY + C (SEQ ID NO: 16598) |
| 145 | +CCTACAATCCCCAAAGY (SEQ ID NO: 16599) |
| 145 | C + CTACAATCCCCAAAGY (SEQ ID NO: 16600) |
| 145 | CCTACAA + TCCCCAAAGY (SEQ ID NO: 16601) |
| 145 | CC + TACAATCCCCAAAGY (SEQ ID NO: 16602) |
| 145 | CCTACAATCCCCAAAGY (SEQ ID NO: 16603) |
| 145 | CCTACAATCCCCA + AAGY (SEQ ID NO: 16604) |
| 145 | CCTACAATCCCC + AAAGY (SEQ ID NO: 16605) |
| 145 | CCTACAATCCCCAA + AGY (SEQ ID NO: 16606) |
| 145 | C + CTACAA + TC + CCCAAAGY (SEQ ID NO: 16607) |
| 145 | CC + TACAA + TC + CCCAAAGY (SEQ ID NO: 16608) |
| 145 | CCTACA + A + TC + CCCAAAGY (SEQ ID NO: 16609) |
| 145 | CCTA + CAA + TC + CCCAAAGY (SEQ ID NO: 16610) |
| 145 | CCTACAA + TC + CCCAA + AGY (SEQ ID NO: 16611) |
| 145 | CCTACAA + TC + C + CCAAAGY (SEQ ID NO: 16612) |
| 145 | CCTACAA + TC + CCCA + AAGY (SEQ ID NO: 16613) |
| 145 | CCTACAA + TC + CCCAAAGY (SEQ ID NO: 16614) |
| 145 | +CCTACAATCCCCAAA (SEQ ID NO: 16615) |
| 145 | C + CTACAATCCCCAAA (SEQ ID NO: 16616) |
| 145 | CCTACAA + TCCCCAAA (SEQ ID NO: 16617) |
| 145 | CC + TACAATCCCCAAA (SEQ ID NO: 16618) |
| 145 | CCTACAATCCCCAAAG (SEQ ID NO: 16619) |
| 145 | CCTACAATCCCCA + AA (SEQ ID NO: 16620) |
| 145 | CCTACAATCCCC + AAA (SEQ ID NO: 16621) |
| 145 | CCTACAATCCCCAA + A (SEQ ID NO: 16622) |
| 145 | C + CTACAA + TC + CCCAAA (SEQ ID NO: 16623) |
| 145 | CC + TACAA + TC + CCCAAA (SEQ ID NO: 16624) |
| 145 | CCTACA + A + TC + CCCAAA (SEQ ID NO: 16625) |
| 145 | CCTA + CAA + TC + CCCAAA (SEQ ID NO: 16626) |
| 145 | CCTACAA + TC + CCCAA + A (SEQ ID NO: 16627) |
| 145 | CCTACAA + TC + C + CCAAA (SEQ ID NO: 16628) |
| 145 | CCTACAA + TC + CCCA + AA (SEQ ID NO: 16629) |
| 145 | CCTACAA + TC + CCCAAAG (SEQ ID NO: 16630) |
| 145 | +CCTACAATCCCCA (SEQ ID NO: 16631) |
| 145 | C + CTACAATCCCCA (SEQ ID NO: 16632) |
| 145 | CCTACAA + TCCCCA (SEQ ID NO: 16633) |
| 145 | CC + TACAATCCCCA (SEQ ID NO: 16634) |
| 145 | CCTACAATCCCAA (SEQ ID NO: 16635) |
| 145 | CCTACAATCCCCA (SEQ ID NO: 16636) |
| 145 | CCTACAATCCCC + A (SEQ ID NO: 16637) |
| 145 | C + CTACAA + TC + CCCA (SEQ ID NO: 16638) |
| 145 | CC + TACAA + TC + CCCA (SEQ ID NO: 16639) |
| 145 | CCTACA + A + TC + CCCA (SEQ ID NO: 16640) |
| 145 | CCTA + CAA + TC + CCCA (SEQ ID NO: 16641) |
| 145 | CCTACAA + TC + CCCAA (SEQ ID NO: 16642) |
| 145 | CCTACAA + TC + C + CCA (SEQ ID NO: 16643) |
| 145 | CCTACAA + TC + CCCA (SEQ ID NO: 16644) |
| 145 | CCCTACAATCCCCAAAGYC (SEQ ID NO: 16645) |
| 145 | CCTACAATCCCCAAAGY (SEQ ID NO: 16646) |
| 145 | CCTACAATCCCCAAA (SEQ ID NO: 16647) |
| 145 | CCTACAATCCCCA (SEQ ID NO: 16648) |
| 145 | TACAATCCYCAAAGT (SEQ ID NO: 16649) |
| 146 | ACAAT + CCCCAAAGYCARGG (SEQ ID NO: 16650) |
| 146 | ACAATCC + CCAAAGYCARGG (SEQ ID NO: 16651) |
| 146 | ACAA + TCCCCAAAGYCARGG (SEQ ID NO: 16652) |
| 146 | ACA + ATCCCCAAAGYCARGG (SEQ ID NO: 16653) |
| 146 | ACAATCCCCAAAGYCA + RGG (SEQ ID NO: 16654) |
| 146 | ACAATCCCCA + AAGYCARGG (SEQ ID NO: 16655) |
| 146 | ACAATCCCCAAAGYC + ARGG (SEQ ID NO: 16656) |
| 146 | ACAATCCCCAAAGY + CARGG (SEQ ID NO: 16657) |
| 146 | ACAA + TCCC + CA + AAGYCARGG (SEQ ID NO: 16658) |
| 146 | A + CAATCCC + CA + AAGYCARGG (SEQ ID NO: 16659) |
| 146 | AC + AATCCC + CA + AAGYCARGG (SEQ ID NO: 16660) |
| 146 | ACAAT + CCC + CA + AAGYCARGG (SEQ ID NO: 16661) |
| 146 | ACAATCCC + CA + AAGYCAR + GG (SEQ ID NO: 16662) |
| 146 | ACAATCCC + CA + A + AGYCARGG (SEQ ID NO: 16663) |
| 146 | ACAATCCC + CA + AAGY + CARGG (SEQ ID NO: 16664) |

TABLE 13-continued

| | | |
|---|---|---|
| 146 | ACAATCCC + CA + AAGYCA + RGG (SEQ ID NO: 16665) | |
| 146 | CAAT + CCCCAAAGYCARG (SEQ ID NO: 16666) | |
| 146 | CAATCC + CCAAAGYCARG (SEQ ID NO: 16667) | |
| 146 | CAA + TCCCCAAAGYCARG (SEQ ID NO: 16668) | |
| 146 | CA + ATCCCCAAAGYCARG (SEQ ID NO: 16669) | |
| 146 | CAATCCCCAAAGYCA + RG (SEQ ID NO: 16670) | |
| 146 | CAATCCCCA + AAGYCARG (SEQ ID NO: 16671) | |
| 146 | CAATCCCCAAAGYC + ARG (SEQ ID NO: 16672) | |
| 146 | CAATCCCCAAAGY + CARG (SEQ ID NO: 16673) | |
| 146 | CAA + TCCC + CA + AAGYCARG (SEQ ID NO: 16674) | |
| 146 | +CAATCCC + CA + AAGYCARG (SEQ ID NO: 16675) | |
| 146 | C + AATCCC + CA + AAGYCARG (SEQ ID NO: 16676) | |
| 146 | CAAT + CCC + CA + AAGYCARG (SEQ ID NO: 16677) | |
| 146 | CAATCCC + CA + AAGYCAR + G (SEQ ID NO: 16678) | |
| 146 | CAATCCC + CA + A + AGYCARG (SEQ ID NO: 16679) | |
| 146 | CAATCCC + CA + AAGY + CARG (SEQ ID NO: 16680) | |
| 146 | CAATCCC + CA + AAGYCA + RG (SEQ ID NO: 16681) | |
| 146 | CAAT + CCCCAAAGYCA (SEQ ID NO: 16682) | |
| 146 | CAATCC + CCAAAGYCA (SEQ ID NO: 16683) | |
| 146 | CAA + TCCCCAAAGYCA (SEQ ID NO: 16684) | |
| 146 | CA + ATCCCCAAAGYCA (SEQ ID NO: 16685) | |
| 146 | CAATCCCCAAAGYCA (SEQ ID NO: 16686) | |
| 146 | CAATCCCCA + AAGYCA (SEQ ID NO: 16687) | |
| 146 | CAATCCCCAAAGYC + A (SEQ ID NO: 16688) | |
| 146 | CAATCCCCAAAGY + CA (SEQ ID NO: 16689) | |
| 146 | CAA + TCCC + CA + AAGYCA (SEQ ID NO: 16690) | |
| 146 | +CAATCCC + CA + AAGYCA (SEQ ID NO: 16691) | |
| 146 | C + AATCCC + CA + AAGYCA (SEQ ID NO: 16692) | |
| 146 | CAAT + CCC + CA + AAGYCA (SEQ ID NO: 16693) | |
| 146 | CAATCCC + CA + AAGYCAR (SEQ ID NO: 16694) | |
| 146 | CAATCCC + CA + A + AGYCA (SEQ ID NO: 16695) | |
| 146 | CAATCCC + CA + AAGY + CA (SEQ ID NO: 16696) | |
| 146 | CAATCCC + CA + AAGYCA (SEQ ID NO: 16697) | |
| 146 | CAAT + CCCCAAAGY (SEQ ID NO: 16698) | |
| 146 | CAATCC + CCAAAGY (SEQ ID NO: 16699) | |
| 146 | CAA + TCCCCAAAGY (SEQ ID NO: 16700) | |
| 146 | CA + ATCCCCAAAGY (SEQ ID NO: 16701) | |
| 146 | CAATCCCCAAAGYC (SEQ ID NO: 16702) | |
| 146 | CAATCCCCA + AAGY (SEQ ID NO: 16703) | |
| 146 | CAATCCCCAAAGY (SEQ ID NO: 16704) | |
| 146 | CAA + TCCC + CA + AAGY (SEQ ID NO: 16705) | |
| 146 | +CAATCCC + CA + AAGY (SEQ ID NO: 16706) | |
| 146 | C + AATCCC + CA + AAGY (SEQ ID NO: 16707) | |
| 146 | CAAT + CCC + CA + AAGY (SEQ ID NO: 16708) | |
| 146 | CAATCCC + CA + AAGYC (SEQ ID NO: 16709) | |
| 146 | CAATCCC + CA + A + AGY (SEQ ID NO: 16710) | |
| 146 | CAATCCC + CA + AAGY (SEQ ID NO: 16711) | |
| 146 | ACAATCCCCAAAGYCARGG (SEQ ID NO: 16712) | |
| 146 | CAATCCCCAAAGYCARG (SEQ ID NO: 16713) | |
| 146 | CAATCCCCAAAGYCA (SEQ ID NO: 16714) | |
| 146 | CAATCCCCAAAGYCAR (SEQ ID NO: 16715) | |
| 146 | CAATCCCCAAAGY (SEQ ID NO: 16716) | |
| 146 | AATCCCCARAGTCAA (SEQ ID NO: 16717) | |
| 147 | AATCCCC + AAAGYCARGGAG (SEQ ID NO: 16718) | |
| 147 | AAT + CCCCAAAGYCARGGAG (SEQ ID NO: 16719) | |
| 147 | AATCCC + CAAAGYCARGGAG (SEQ ID NO: 16720) | |
| 147 | AATCC + CCAAAGYCARGGAG (SEQ ID NO: 16721) | |
| 147 | AATCCCCAAAGYCARG + GAG (SEQ ID NO: 16722) | |
| 147 | AATCCCCAAAGYCARGG + AG (SEQ ID NO: 16723) | |
| 147 | AATCCCCAAAGYCARGGA + G (SEQ ID NO: 16724) | |
| 147 | AATCCCCAAAGY + CARGGAG (SEQ ID NO: 16725) | |
| 147 | A + ATCCCCA + AA + GYCARGGAG (SEQ ID NO: 16726) | |
| 147 | AATCCC + CA + AA + GYCARGGAG (SEQ ID NO: 16727) | |
| 147 | AATC + CCCA + AA + GYCARGGAG (SEQ ID NO: 16728) | |
| 147 | AAT + CCCCA + AA + GYCARGGAG (SEQ ID NO: 16729) | |
| 147 | AATCCCCA + AA + GYCA + RGGAG (SEQ ID NO: 16730) | |
| 147 | AATCCCCA + AA + G + YCARGGAG (SEQ ID NO: 16731) | |
| 147 | AATCCCCA + AA + GY + CARGGAG (SEQ ID NO: 16732) | |
| 147 | AATCCCCA + AA + GYCARGG + AG (SEQ ID NO: 16733) | |
| 147 | ATCCCC + AAAGYCARGGA (SEQ ID NO: 16734) | |
| 147 | AT + CCCCAAAGYCARGGA (SEQ ID NO: 16735) | |
| 147 | ATCCC + CAAAGYCARGGA (SEQ ID NO: 16736) | |

TABLE 13-continued

| | | |
|---|---|---|
| 147 | ATCC + CCAAAGYCARGGA | (SEQ ID NO: 16737) |
| 147 | ATCCCCAAAGYCARG + GA | (SEQ ID NO: 16738) |
| 147 | ATCCCCAAAGYCARGG + A | (SEQ ID NO: 16739) |
| 147 | ATCCCCAAAGYCARGGA | (SEQ ID NO: 16740) |
| 147 | ATCCCCAAAGY + CARGGA | (SEQ ID NO: 16741) |
| 147 | +ATCCCCA + AA + GYCARGGA | (SEQ ID NO: 16742) |
| 147 | ATCCC + CA + AA + GYCARGGA | (SEQ ID NO: 16743) |
| 147 | ATC + CCCA + AA + GYCARGGA | (SEQ ID NO: 16744) |
| 147 | AT + CCCCA + AA + GYCARGGA | (SEQ ID NO: 16745) |
| 147 | ATCCCCA + AA + GYCA + RGGA | (SEQ ID NO: 16746) |
| 147 | ATCCCCA + AA + G + YCARGGA | (SEQ ID NO: 16747) |
| 147 | ATCCCCA + AA + GY + CARGGA | (SEQ ID NO: 16748) |
| 147 | ATCCCCA + AA + GYCARGG + A | (SEQ ID NO: 16749) |
| 147 | ATCCCC + AAAGYCARG | (SEQ ID NO: 16750) |
| 147 | AT + CCCCAAAGYCARG | (SEQ ID NO: 16751) |
| 147 | ATCCC + CAAAGYCARG | (SEQ ID NO: 16752) |
| 147 | ATCC + CCAAAGYCARG | (SEQ ID NO: 16753) |
| 147 | ATCCCCAAAGYCARG | (SEQ ID NO: 16754) |
| 147 | ATCCCCAAAGYCARGG | (SEQ ID NO: 16755) |
| 147 | ATCCCCAAAGY + CARG | (SEQ ID NO: 16756) |
| 147 | +ATCCCCA + AA + GYCARG | (SEQ ID NO: 16757) |
| 147 | ATCCC + CA + AA + GYCARG | (SEQ ID NO: 16758) |
| 147 | ATC + CCCA + AA + GYCARG | (SEQ ID NO: 16759) |
| 147 | AT + CCCCA + AA + GYCARG | (SEQ ID NO: 16760) |
| 147 | ATCCCCA + AA + GYCA + RG | (SEQ ID NO: 16761) |
| 147 | ATCCCCA + AA + G + YCARG | (SEQ ID NO: 16762) |
| 147 | ATCCCCA + AA + GY + CARG | (SEQ ID NO: 16763) |
| 147 | ATCCCCA + AA + GYCARGG | (SEQ ID NO: 16764) |
| 147 | ATCCCC + AAAGYCA | (SEQ ID NO: 16765) |
| 147 | AT + CCCCAAAGYCA | (SEQ ID NO: 16766) |
| 147 | ATCCC + CAAAGYCA | (SEQ ID NO: 16767) |
| 147 | ATCC + CCAAAGYCA | (SEQ ID NO: 16768) |
| 147 | ATCCCCAAAGYCAR | (SEQ ID NO: 16769) |
| 147 | ATCCCCAAAGY + CA | (SEQ ID NO: 16770) |
| 147 | +ATCCCCA + AA + GYCA | (SEQ ID NO: 16771) |
| 147 | ATCCC + CA + AA + GYCA | (SEQ ID NO: 16772) |
| 147 | ATC + CCCA + AA + GYCA | (SEQ ID NO: 16773) |
| 147 | AT + CCCCA + AA + GYCA | (SEQ ID NO: 16774) |
| 147 | ATCCCCA + AA + GYCA | (SEQ ID NO: 16775) |
| 147 | ATCCCCA + AA + G + YCA | (SEQ ID NO: 16776) |
| 147 | ATCCCCA + AA + GY + CA | (SEQ ID NO: 16777) |
| 147 | ATCCCCA + AA + GYCAR | (SEQ ID NO: 16778) |
| 147 | AATCCCCAAAGYCARGGAG | (SEQ ID NO: 16779) |
| 147 | ATCCCCAAAGYCARGGA | (SEQ ID NO: 16780) |
| 147 | ATCCCCAAAGYCARG | (SEQ ID NO: 16781) |
| 147 | ATCCCCAAAGYCA | (SEQ ID NO: 16782) |
| 147 | TCCCCAAAGYCAAGG | (SEQ ID NO: 16783) |
| 148 | CCAAA + GYCARGGAGTAGTR | (SEQ ID NO: 16784) |
| 148 | CCA + AAGYCARGGAGTAGTR | (SEQ ID NO: 16785) |
| 148 | C + CAAAGYCARGGAGTAGTR | (SEQ ID NO: 16786) |
| 148 | CC + AAAGYCARGGAGTAGTR | (SEQ ID NO: 16787) |
| 148 | CCAAAGYCARGGAGT + AGTR | (SEQ ID NO: 16788) |
| 148 | CCAAAGYCARGGAGTA + GTR | (SEQ ID NO: 16789) |
| 148 | CCAAAGYCARGGA + GTAGTR | (SEQ ID NO: 16790) |
| 148 | CCAAAGYCARG + GAGTAGTR | (SEQ ID NO: 16791) |
| 148 | CCAAAGY + C + AR + GGAGTAGTR | (SEQ ID NO: 16792) |
| 148 | CCA + AAGYC + AR + GGAGTAGTR | (SEQ ID NO: 16793) |
| 148 | CC + AAAGYC + AR + GGAGTAGTR | (SEQ ID NO: 16794) |
| 148 | CCAA + AGYC + AR + GGAGTAGTR | (SEQ ID NO: 16795) |
| 148 | CCAAAGYC + AR + GG + AGTAGTR | (SEQ ID NO: 16796) |
| 148 | CCAAAGYC + AR + GGAG + TAGTR | (SEQ ID NO: 16797) |
| 148 | CCAAAGYC + AR + GGAGTAGT + R | (SEQ ID NO: 16798) |
| 148 | CCAAAGYC + AR + GGAGT + AGTR | (SEQ ID NO: 16799) |
| 148 | CCC + CAAAGYCARGGAGTAG | (SEQ ID NO: 16800) |
| 148 | CCCCA + AAGYCARGGAGTAG | (SEQ ID NO: 16801) |
| 148 | CCCCAAAG + YCARGGAGTAG | (SEQ ID NO: 16802) |
| 148 | CCCCAAA + GYCARGGAGTAG | (SEQ ID NO: 16803) |
| 148 | CCCCAAAGYCARGGAG + TAG | (SEQ ID NO: 16804) |
| 148 | CCCCAAAGYCARG + GAGTAG | (SEQ ID NO: 16805) |
| 148 | CCCCAAAGYC + ARGGAGTAG | (SEQ ID NO: 16806) |
| 148 | CCCCAAAGYCAR + GGAGTAG | (SEQ ID NO: 16807) |
| 148 | CCC + CAAAG + YC + ARGGAGTAG | (SEQ ID NO: 16808) |

| | | |
|---|---|---|
| 148 | CCCCA + AAG + YC + ARGGAGTAG (SEQ ID NO: 16809) | |
| 148 | CC + CCAAAG + YC + ARGGAGTAG (SEQ ID NO: 16810) | |
| 148 | CCCC + AAAG + YC + ARGGAGTAG (SEQ ID NO: 16811) | |
| 148 | CCCCAAAG + YC + AR + GGAGTAG (SEQ ID NO: 16812) | |
| 148 | CCCCAAAG + YC + ARGGA + GTAG (SEQ ID NO: 16813) | |
| 148 | CCCCAAAG + YC + ARGGAG + TAG (SEQ ID NO: 16814) | |
| 148 | CCCCAAAG + YC + ARGGAGTA + G (SEQ ID NO: 16815) | |
| 148 | CCCAA + AGYCARGGAGTAGT (SEQ ID NO: 16816) | |
| 148 | CCC + AAAGYCARGGAGTAGT (SEQ ID NO: 16817) | |
| 148 | CCCAAAG + YCARGGAGTAGT (SEQ ID NO: 16818) | |
| 148 | CCCAAAGY + CARGGAGTAGT (SEQ ID NO: 16819) | |
| 148 | CCCAAAGYCARGGAG + TAGT (SEQ ID NO: 16820) | |
| 148 | CCCAAAGYCARGGAGTA + GT (SEQ ID NO: 16821) | |
| 148 | CCCAAAGYCARGG + AGTAGT (SEQ ID NO: 16822) | |
| 148 | CCCAAAGYCAR + GGAGTAGT (SEQ ID NO: 16823) | |
| 148 | CCCAAAG + Y + CA + RGGAGTAGT (SEQ ID NO: 16824) | |
| 148 | CC + CAAAGY + CA + RGGAGTAGT (SEQ ID NO: 16825) | |
| 148 | CCCAAA + GY + CA + RGGAGTAGT (SEQ ID NO: 16826) | |
| 148 | C + CCAAAGY + CA + RGGAGTAGT (SEQ ID NO: 16827) | |
| 148 | CCCAAAGY + CA + RGG + AGTAGT (SEQ ID NO: 16828) | |
| 148 | CCCAAAGY + CA + R + GGAGTAGT (SEQ ID NO: 16829) | |
| 148 | CCCAAAGY + CA + RGGAG + TAGT (SEQ ID NO: 16830) | |
| 148 | CCCAAAGY + CA + RGGAGT + AGT (SEQ ID NO: 16831) | |
| 148 | CAAA + GYCARGGAGTAGT (SEQ ID NO: 16832) | |
| 148 | CA + AAGYCARGGAGTAGT (SEQ ID NO: 16833) | |
| 148 | +CAAAGYCARGGAGTAGT (SEQ ID NO: 16834) | |
| 148 | C + AAAGYCARGGAGTAGT (SEQ ID NO: 16835) | |
| 148 | CAAAGYCARGGAGT + AGT (SEQ ID NO: 16836) | |
| 148 | CAAAGYCARGGAGTA + GT (SEQ ID NO: 16837) | |
| 148 | CAAAGYCARGGA + GTAGT (SEQ ID NO: 16838) | |
| 148 | CAAAGYCARG + GAGTAGT (SEQ ID NO: 16839) | |
| 148 | CAAAGY + C + AR + GGAGTAGT (SEQ ID NO: 16840) | |
| 148 | CA + AAGYC + AR + GGAGTAGT (SEQ ID NO: 16841) | |
| 148 | C + AAAGYC + AR + GGAGTAGT (SEQ ID NO: 16842) | |
| 148 | CAA + AGYC + AR + GGAGTAGT (SEQ ID NO: 16843) | |
| 148 | CAAAGYC + AR + GG + AGTAGT (SEQ ID NO: 16844) | |
| 148 | CAAAGYC + AR + GGAG + TAGT (SEQ ID NO: 16845) | |
| 148 | CAAAGYC + AR + GGAGTAGT (SEQ ID NO: 16846) | |
| 148 | CAAAGYC + AR + GGAGT + AGT (SEQ ID NO: 16847) | |
| 148 | CC + CAAAGYCARGGAGTA (SEQ ID NO: 16848) | |
| 148 | CCCA + AAGYCARGGAGTA (SEQ ID NO: 16849) | |
| 148 | CCCAAAG + YCARGGAGTA (SEQ ID NO: 16850) | |
| 148 | CCCAAA + GYCARGGAGTA (SEQ ID NO: 16851) | |
| 148 | CCCAAAGYCARGGAG + TA (SEQ ID NO: 16852) | |
| 148 | CCCAAAGYCARG + GAGTA (SEQ ID NO: 16853) | |
| 148 | CCCAAAGYC + ARGGAGTA (SEQ ID NO: 16854) | |
| 148 | CCCAAAGYCAR + GGAGTA (SEQ ID NO: 16855) | |
| 148 | CC + CAAAG + YC + ARGGAGTA (SEQ ID NO: 16856) | |
| 148 | CCCA + AAG + YC + ARGGAGTA (SEQ ID NO: 16857) | |
| 148 | C + CCAAAG + YC + ARGGAGTA (SEQ ID NO: 16858) | |
| 148 | CCC + AAAG + YC + ARGGAGTA (SEQ ID NO: 16859) | |
| 148 | CCCAAAG + YC + AR + GGAGTA (SEQ ID NO: 16860) | |
| 148 | CCCAAAG + YC + ARGGA + GTA (SEQ ID NO: 16861) | |
| 148 | CCCAAAG + YC + ARGGAG + TA (SEQ ID NO: 16862) | |
| 148 | CCCAAAG + YC + ARGGAGTA (SEQ ID NO: 16863) | |
| 148 | CCAA + AGYCARGGAGTAG (SEQ ID NO: 16864) | |
| 148 | CC + AAAGYCARGGAGTAG (SEQ ID NO: 16865) | |
| 148 | CCAAAG + YCARGGAGTAG (SEQ ID NO: 16866) | |
| 148 | CCAAAGY + CARGGAGTAG (SEQ ID NO: 16867) | |
| 148 | CCAAAGYCARGGAG + TAG (SEQ ID NO: 16868) | |
| 148 | CCAAAGYCARGGAGTA + G (SEQ ID NO: 16869) | |
| 148 | CCAAAGYCARGG + AGTAG (SEQ ID NO: 16870) | |
| 148 | CCAAAGYCAR + GGAGTAG (SEQ ID NO: 16871) | |
| 148 | CCAAAG + Y + CA + RGGAGTAG (SEQ ID NO: 16872) | |

TABLE 13-continued

| | |
|---|---|
| 148 | C + CAAAGY + CA + RGGAGTAG (SEQ ID NO: 16873) |
| 148 | CCAAA + GY + CA + RGGAGTAG (SEQ ID NO: 16874) |
| 148 | +CCAAAGY + CA + RGGAGTAG (SEQ ID NO: 16875) |
| 148 | CCAAAGY + CA + RGG + AGTAG (SEQ ID NO: 16876) |
| 148 | CCAAAGY + CA + R + GGAGTAG (SEQ ID NO: 16877) |
| 148 | CCAAAGY + CA + RGGAG + TAG (SEQ ID NO: 16878) |
| 148 | CCAAAGY + CA + RGGAGT + AG (SEQ ID NO: 16879) |
| 148 | CAAA + GYCARGGAGTA (SEQ ID NO: 16880) |
| 148 | CA + AAGYCARGGAGTA (SEQ ID NO: 16881) |
| 148 | +CAAAGYCARGGAGTA (SEQ ID NO: 16882) |
| 148 | C + AAAGYCARGGAGTA (SEQ ID NO: 16883) |
| 148 | CAAAGYCARGGAGT + A (SEQ ID NO: 16884) |
| 148 | CAAAGYCARGGAGTA (SEQ ID NO: 16885) |
| 148 | CAAAGYCARGGA + GTA (SEQ ID NO: 16886) |
| 148 | CAAAGYCARG + GAGTA (SEQ ID NO: 16887) |
| 148 | CAAAGY + C + AR + GGAGTA (SEQ ID NO: 16888) |
| 148 | CA + AAGYC + AR + GGAGTA (SEQ ID NO: 16889) |
| 148 | C + AAAGYC + AR + GGAGTA (SEQ ID NO: 16890) |
| 148 | CAA + AGYC + AR + GGAGTA (SEQ ID NO: 16891) |
| 148 | CAAAGYC + AR + GG + AGTA (SEQ ID NO: 16892) |
| 148 | CAAAGYC + AR + GGAG + TA (SEQ ID NO: 16893) |
| 148 | CAAAGYC + AR + GGAGTAG (SEQ ID NO: 16894) |
| 148 | CAAAGYC + AR + GGAGT + A (SEQ ID NO: 16895) |
| 148 | CC + CAAAGYCARGGAG (SEQ ID NO: 16896) |
| 148 | CCCA + AAGYCARGGAG (SEQ ID NO: 16897) |
| 148 | CCCAAAG + YCARGGAG (SEQ ID NO: 16898) |
| 148 | CCCAAA + GYCARGGAG (SEQ ID NO: 16899) |
| 148 | CCCAAAGYCARGGAG (SEQ ID NO: 16900) |
| 148 | CCCAAAGYCARG + GAG (SEQ ID NO: 16901) |
| 148 | CCCAAAGYC + ARGGAG (SEQ ID NO: 16902) |
| 148 | CCCAAAGYCAR + GGAG (SEQ ID NO: 16903) |
| 148 | CC + CAAAG + YC + ARGGAG (SEQ ID NO: 16904) |
| 148 | CCCA + AAG + YC + ARGGAG (SEQ ID NO: 16905) |
| 148 | C + CCAAAG + YC + ARGGAG (SEQ ID NO: 16906) |
| 148 | CCC + AAAG + YC + ARGGAG (SEQ ID NO: 16907) |
| 148 | CCCAAAG + YC + AR + GGAG (SEQ ID NO: 16908) |
| 148 | CCCAAAG + YC + ARGGA + G (SEQ ID NO: 16909) |
| 148 | CCCAAAG + YC + ARGGAG (SEQ ID NO: 16910) |
| 148 | CCCAAAG + YC + ARGGAGT (SEQ ID NO: 16911) |
| 148 | CCAA + AGYCARGGAGT (SEQ ID NO: 16912) |
| 148 | CC + AAAGYCARGGAGT (SEQ ID NO: 16913) |
| 148 | CCAAAG + YCARGGAGT (SEQ ID NO: 16914) |
| 148 | CCAAAGY + CARGGAGT (SEQ ID NO: 16915) |
| 148 | CCAAAGYCARGGAG + T (SEQ ID NO: 16916) |
| 148 | CCAAAGYCARGGAGTA (SEQ ID NO: 16917) |
| 148 | CCAAAGYCARGG + AGT (SEQ ID NO: 16918) |
| 148 | CCAAAGYCAR + GGAGT (SEQ ID NO: 16919) |
| 148 | CCAAAG + Y + CA + RGGAGT (SEQ ID NO: 16920) |
| 148 | C + CAAAGY + CA + RGGAGT (SEQ ID NO: 16921) |
| 148 | CCAAA + GY + CA + RGGAGT (SEQ ID NO: 16922) |
| 148 | +CCAAAGY + CA + RGGAGT (SEQ ID NO: 16923) |
| 148 | CCAAAGY + CA + RGG + AGT (SEQ ID NO: 16924) |
| 148 | CCAAAGY + CA + R + GGAGT (SEQ ID NO: 16925) |
| 148 | CCAAAGY + CA + RGGAG + T (SEQ ID NO: 16926) |
| 148 | CCAAAGY + CA + RGGAGT (SEQ ID NO: 16927) |
| 148 | CAAA + GYCARGGAG (SEQ ID NO: 16928) |
| 148 | CA + AAGYCARGGAG (SEQ ID NO: 16929) |
| 148 | +CAAAGYCARGGAG (SEQ ID NO: 16930) |
| 148 | C + AAAGYCARGGAG (SEQ ID NO: 16931) |
| 148 | CAAAGYCARGGAGT (SEQ ID NO: 16932) |
| 148 | CAAAGYCARGGA + G (SEQ ID NO: 16933) |
| 148 | CAAAGYCARG + GAG (SEQ ID NO: 16934) |
| 148 | CAAAGY + C + AR + GGAG (SEQ ID NO: 16935) |
| 148 | CA + AAGYC + AR + GGAG (SEQ ID NO: 16936) |
| 148 | C + AAAGYC + AR + GGAG (SEQ ID NO: 16937) |
| 148 | CAA + AGYC + AR + GGAG (SEQ ID NO: 16938) |
| 148 | CAAAGYC + AR + GG + AG (SEQ ID NO: 16939) |
| 148 | CAAAGYC + AR + GGAG (SEQ ID NO: 16940) |
| 148 | CAAAGYC + AR + GGAGT (SEQ ID NO: 16941) |
| 148 | CC + CAAAGYCARGG (SEQ ID NO: 16942) |
| 148 | CCCA + AAGYCARGG (SEQ ID NO: 16943) |
| 148 | CCCAAAG + YCARGG (SEQ ID NO: 16944) |
| 148 | CCCAAA + GYCARGG (SEQ ID NO: 16945) |
| 148 | CCCAAAGYCARGGA (SEQ ID NO: 16946) |
| 148 | CCCAAAGYCARG + G (SEQ ID NO: 16947) |
| 148 | CCCAAAGYC + ARGG (SEQ ID NO: 16948) |
| 148 | CCCAAAGYCAR + GG (SEQ ID NO: 16949) |

TABLE 13-continued

| | | |
|---|---|---|
| 148 | CC + CAAAG + YC + ARGG | (SEQ ID NO: 16950) |
| 148 | CCCA + AAG + YC + ARGG | (SEQ ID NO: 16951) |
| 148 | C + CCAAAG + YC + ARGG | (SEQ ID NO: 16952) |
| 148 | CCC + AAAG + YC + ARGG | (SEQ ID NO: 16953) |
| 148 | CCCAAAG + YC + AR + GG | (SEQ ID NO: 16954) |
| 148 | CCCAAAG + YC + ARGGA | (SEQ ID NO: 16955) |
| 148 | CCAA + AGYCARGGA | (SEQ ID NO: 16956) |
| 148 | CC + AAAGYCARGGA | (SEQ ID NO: 16957) |
| 148 | CCAAAG + YCARGGA | (SEQ ID NO: 16958) |
| 148 | CCAAAGY + CARGGA | (SEQ ID NO: 16959) |
| 148 | CCAAAGYCARGGAG | (SEQ ID NO: 16960) |
| 148 | CCAAAGYCARGG + A | (SEQ ID NO: 16961) |
| 148 | CCAAAGYCAR + GGA | (SEQ ID NO: 16962) |
| 148 | CCAAAG + Y + CA + RGGA | (SEQ ID NO: 16963) |
| 148 | C + CAAAGY + CA + RGGA | (SEQ ID NO: 16964) |
| 148 | CCAAA + GY + CA + RGGA | (SEQ ID NO: 16965) |
| 148 | +CCAAAGY + CA + RGGA | (SEQ ID NO: 16966) |
| 148 | CCAAAGY + CA + RGG + A | (SEQ ID NO: 16967) |
| 148 | CCAAAGY + CA + R + GGA | (SEQ ID NO: 16968) |
| 148 | CCAAAGY + CA + RGGAG | (SEQ ID NO: 16969) |
| 148 | CCAAAGYCARGGAGTAGTR | (SEQ ID NO: 16970) |
| 148 | CCCCAAAGYCARGGAGTAG | (SEQ ID NO: 16971) |
| 148 | CCCAAAGYCARGGAGTAGT | (SEQ ID NO: 16972) |
| 148 | CAAAGYCARGGAGTAGT | (SEQ ID NO: 16973) |
| 148 | CCCAAAGYCARGGAGTA | (SEQ ID NO: 16974) |
| 148 | CCAAAGYCARGGAGTAG | (SEQ ID NO: 16975) |
| 148 | CAAAGYCARGGAGTA | (SEQ ID NO: 16976) |
| 148 | CAAAGYCARGGAGTAG | (SEQ ID NO: 16977) |
| 148 | CCCAAAGYCARGGAG | (SEQ ID NO: 16978) |
| 148 | CCCAAAGYCARGGAGT | (SEQ ID NO: 16979) |
| 148 | CCAAAGYCARGGAGT | (SEQ ID NO: 16980) |
| 148 | CAAAGYCARGGAG | (SEQ ID NO: 16981) |
| 148 | CCCAAAGYCARGG | (SEQ ID NO: 16982) |
| 148 | CCAAAGYCARGGA | (SEQ ID NO: 16983) |
| 148 | CAAAGTCARGGAGTA | (SEQ ID NO: 16984) |
| 153 | ATTCATRCTTTCTAC | (SEQ ID NO: 16985) |
| 155 | GARTCYAT + GAATAARGAAT | (SEQ ID NO: 16986) |
| 155 | G + ARTCYATGAATAARGAAT | (SEQ ID NO: 16987) |
| 155 | GARTCY + ATGAATAARGAAT | (SEQ ID NO: 16988) |
| 155 | GART + CYATGAATAARGAAT | (SEQ ID NO: 16989) |
| 155 | GARTCYATGAATAAR + GAAT | (SEQ ID NO: 16990) |
| 155 | GARTCYATGAATAARGA + AT | (SEQ ID NO: 16991) |
| 155 | GARTCYATGAATAA + RGAAT | (SEQ ID NO: 16992) |
| 155 | GARTCYATGAA + TAARGAAT | (SEQ ID NO: 16993) |
| 155 | GARTCYA + T + GA + ATAARGAAT | (SEQ ID NO: 16994) |
| 155 | G + ARTCYAT + GA + ATAARGAAT | (SEQ ID NO: 16995) |
| 155 | GAR + TCYAT + GA + ATAARGAAT | (SEQ ID NO: 16996) |
| 155 | GART + CYAT + GA + ATAARGAAT | (SEQ ID NO: 16997) |
| 155 | GARTCYAT + GA + AT + AARGAAT | (SEQ ID NO: 16998) |
| 155 | GARTCYAT + GA + ATA + ARGAAT | (SEQ ID NO: 16999) |
| 155 | GARTCYAT + GA + ATAARGA + AT | (SEQ ID NO: 17000) |
| 155 | GARTCYAT + GA + ATAARG + AAT | (SEQ ID NO: 17001) |
| 155 | ART + CYATGAATAARGAATT | (SEQ ID NO: 17002) |
| 155 | ARTCY + ATGAATAARGAATT | (SEQ ID NO: 17003) |
| 155 | AR + TCYATGAATAARGAATT | (SEQ ID NO: 17004) |
| 155 | A + RTCYATGAATAARGAATT | (SEQ ID NO: 17005) |
| 155 | ARTCYATGAATAARGAAT + T | (SEQ ID NO: 17006) |
| 155 | ARTCYATGAA + TAARGAATT | (SEQ ID NO: 17007) |
| 155 | ARTCYATGAATAAR + GAATT | (SEQ ID NO: 17008) |
| 155 | ARTCYATGAATAARG + AATT | (SEQ ID NO: 17009) |
| 155 | AR + TCYATG + AA + TAARGAATT | (SEQ ID NO: 17010) |
| 155 | ARTCYA + TG + AA + TAARGAATT | (SEQ ID NO: 17011) |
| 155 | ARTCY + ATG + AA + TAARGAATT | (SEQ ID NO: 17012) |
| 155 | ARTCYAT + G + AA + TAARGAATT | (SEQ ID NO: 17013) |
| 155 | ARTCYATG + AA + TAAR + GAATT | (SEQ ID NO: 17014) |
| 155 | ARTCYATG + AA + TAARGA + ATT | (SEQ ID NO: 17015) |
| 155 | ARTCYATG + AA + TAARGAA + TT | (SEQ ID NO: 17016) |
| 155 | ARTCYATG + AA + TA + ARGAATT | (SEQ ID NO: 17017) |
| 155 | ARTCYAT + GAATAARGAA | (SEQ ID NO: 17018) |
| 155 | +ARTCYATGAATAARGAA | (SEQ ID NO: 17019) |
| 155 | ARTCY + ATGAATAARGAA | (SEQ ID NO: 17020) |
| 155 | ART + CYATGAATAARGAA | (SEQ ID NO: 17021) |

TABLE 13-continued

| | | |
|---|---|---|
| 155 | ARTCYATGAATAAR + GAA | (SEQ ID NO: 17022) |
| 155 | ARTCYATGAATAARGA + A | (SEQ ID NO: 17023) |
| 155 | ARTCYATGAATAA + RGAA | (SEQ ID NO: 17024) |
| 155 | ARTCYATGAA + TAARGAA | (SEQ ID NO: 17025) |
| 155 | ARTCYA + T + GA + ATAARGAA | (SEQ ID NO: 17026) |
| 155 | +ARTCYAT + GA + ATAARGAA | (SEQ ID NO: 17027) |
| 155 | AR + TCYAT + GA + ATAARGAA | (SEQ ID NO: 17028) |
| 155 | ART + CYAT + GA + ATAARGAA | (SEQ ID NO: 17029) |
| 155 | ARTCYAT + GA + AT + AARGAA | (SEQ ID NO: 17030) |
| 155 | ARTCYAT + GA + ATA + ARGAA | (SEQ ID NO: 17031) |
| 155 | ARTCYAT + GA + ATAARGA + A | (SEQ ID NO: 17032) |
| 155 | ARTCYAT + GA + ATAARG + AA | (SEQ ID NO: 17033) |
| 155 | RT + CYATGAATAARGAAT | (SEQ ID NO: 17034) |
| 155 | RTCY + ATGAATAARGAAT | (SEQ ID NO: 17035) |
| 155 | R + TCYATGAATAARGAAT | (SEQ ID NO: 17036) |
| 155 | +RTCYATGAATAARGAAT | (SEQ ID NO: 17037) |
| 155 | RTCYATGAATAARGAAT | (SEQ ID NO: 17038) |
| 155 | RTCYATGAA + TAARGAAT | (SEQ ID NO: 17039) |
| 155 | RTCYATGAATAAR + GAAT | (SEQ ID NO: 17040) |
| 155 | RTCYATGAATAARG + AAT | (SEQ ID NO: 17041) |
| 155 | R + TCYATG + AA + TAARGAAT | (SEQ ID NO: 17042) |
| 155 | RTCYA + TG + AA + TAARGAAT | (SEQ ID NO: 17043) |
| 155 | RTCY + ATG + AA + TAARGAAT | (SEQ ID NO: 17044) |
| 155 | RTCYAT + G + AA + TAARGAAT | (SEQ ID NO: 17045) |
| 155 | RTCYATG + AA + TAAR + GAAT | (SEQ ID NO: 17046) |
| 155 | RTCYATG + AA + TAARGA + AT | (SEQ ID NO: 17047) |
| 155 | RTCYATG + AA + TAARGAA + T | (SEQ ID NO: 17048) |
| 155 | RTCYATG + AA + TA + ARGAAT | (SEQ ID NO: 17049) |
| 155 | ARTCYAT + GAATAARG | (SEQ ID NO: 17050) |
| 155 | +ARTCYATGAATAARG | (SEQ ID NO: 17051) |
| 155 | ARTCY + ATGAATAARG | (SEQ ID NO: 17052) |
| 155 | ART + CYATGAATAARG | (SEQ ID NO: 17053) |
| 155 | ARTCYATGAATAAR + G | (SEQ ID NO: 17054) |
| 155 | ARTCYATGAATAARGA | (SEQ ID NO: 17055) |
| 155 | ARTCYATGAATAA + RG | (SEQ ID NO: 17056) |
| 155 | ARTCYATGAA + TAARG | (SEQ ID NO: 17057) |
| 155 | ARTCYA + T + GA + ATAARG | (SEQ ID NO: 17058) |
| 155 | +ARTCYAT + GA + ATAARG | (SEQ ID NO: 17059) |
| 155 | AR + TCYAT + GA + ATAARG | (SEQ ID NO: 17060) |
| 155 | ART + CYAT + GA + ATAARG | (SEQ ID NO: 17061) |
| 155 | ARTCYAT + GA + AT + AARG | (SEQ ID NO: 17062) |
| 155 | ARTCYAT + GA + ATA + ARG | (SEQ ID NO: 17063) |
| 155 | ARTCYAT + GA + ATAARGA | (SEQ ID NO: 17064) |
| 155 | ARTCYAT + GA + ATAARG | (SEQ ID NO: 17065) |
| 155 | RT + CYATGAATAARGA | (SEQ ID NO: 17066) |
| 155 | RTCY + ATGAATAARGA | (SEQ ID NO: 17067) |
| 155 | R + TCYATGAATAARGA | (SEQ ID NO: 17068) |
| 155 | +RTCYATGAATAARGA | (SEQ ID NO: 17069) |
| 155 | RTCYATGAATAARGAA | (SEQ ID NO: 17070) |
| 155 | RTCYATGAA + TAARGA | (SEQ ID NO: 17071) |
| 155 | RTCYATGAATAAR + GA | (SEQ ID NO: 17072) |
| 155 | RTCYATGAATAARG + A | (SEQ ID NO: 17073) |
| 155 | R + TCYATG + AA + TAARGA | (SEQ ID NO: 17074) |
| 155 | RTCYA + TG + AA + TAARGA | (SEQ ID NO: 17075) |
| 155 | RTCY + ATG + AA + TAARGA | (SEQ ID NO: 17076) |
| 155 | RTCYAT + G + AA + TAARGA | (SEQ ID NO: 17077) |
| 155 | RTCYATG + AA + TAAR + GA | (SEQ ID NO: 17078) |
| 155 | RTCYATG + AA + TAARGA | (SEQ ID NO: 17079) |
| 155 | RTCYATG + AA + TAARGAA | (SEQ ID NO: 17080) |
| 155 | RTCYATG + AA + TA + ARGA | (SEQ ID NO: 17081) |
| 155 | ARTCYAT + GAATAA | (SEQ ID NO: 17082) |
| 155 | +ARTCYATGAATAA | (SEQ ID NO: 17083) |
| 155 | ARTCY + ATGAATAA | (SEQ ID NO: 17084) |
| 155 | ART + CYATGAATAA | (SEQ ID NO: 17085) |
| 155 | ARTCYATGAATAAR | (SEQ ID NO: 17086) |
| 155 | ARTCYATGAATAA | (SEQ ID NO: 17087) |
| 155 | ARTCYATGAA + TAA | (SEQ ID NO: 17088) |
| 155 | ARTCYA + T + GA + ATAA | (SEQ ID NO: 17089) |
| 155 | +ARTCYAT + GA + ATAA | (SEQ ID NO: 17090) |
| 155 | AR + TCYAT + GA + ATAA | (SEQ ID NO: 17091) |
| 155 | ART + CYAT + GA + ATAA | (SEQ ID NO: 17092) |
| 155 | ARTCYAT + GA + AT + AA | (SEQ ID NO: 17093) |

TABLE 13-continued

| | | |
|---|---|---|
| 155 | ARTCYAT + GA + ATA + A (SEQ ID NO: 17094) | |
| 155 | ARTCYAT + GA + ATAAR (SEQ ID NO: 17095) | |
| 155 | RT + CYATGAATAAR (SEQ ID NO: 17096) | |
| 155 | RTCY + ATGAATAAR (SEQ ID NO: 17097) | |
| 155 | R + TCYATGAATAAR (SEQ ID NO: 17098) | |
| 155 | +RTCYATGAATAAR (SEQ ID NO: 17099) | |
| 155 | RTCYATGAATAARG (SEQ ID NO: 17100) | |
| 155 | RTCYATGAA + TAAR (SEQ ID NO: 17101) | |
| 155 | RTCYATGAATAAR (SEQ ID NO: 17102) | |
| 155 | R + TCYATG + AA + TAAR (SEQ ID NO: 17103) | |
| 155 | RTCYA + TG + AA + TAAR (SEQ ID NO: 17104) | |
| 155 | RTCY + ATG + AA + TAAR (SEQ ID NO: 17105) | |
| 155 | RTCYAT + G + AA + TAAR (SEQ ID NO: 17106) | |
| 155 | RTCYATG + AA + TAAR (SEQ ID NO: 17107) | |
| 155 | RTCYATG + AA + TAARG (SEQ ID NO: 17108) | |
| 155 | RTCYATG + AA + TA + AR (SEQ ID NO: 17109) | |
| 155 | GARTCYATGAATAARGAAT (SEQ ID NO: 17110) | |
| 155 | ARTCYATGAATAARGAATT (SEQ ID NO: 17111) | |
| 155 | ARTCYATGAATAARGAA (SEQ ID NO: 17112) | |
| 155 | RTCYATGAATAARGAAT (SEQ ID NO: 17113) | |
| 155 | ARTCYATGAATAARG (SEQ ID NO: 17114) | |
| 155 | RTCYATGAATAARGA (SEQ ID NO: 17115) | |
| 155 | ARTCYATGAATAA (SEQ ID NO: 17116) | |
| 155 | RTCYATGAATAAR (SEQ ID NO: 17117) | |
| 155 | TCTATGAAYAAAGAA (SEQ ID NO: 17118) | |
| 163 | AA + AATYATAGGRCARGTMA (SEQ ID NO: 17119) | |
| 163 | AAA + ATYATAGGRCARGTMA (SEQ ID NO: 17120) | |
| 163 | AAAATYA + TAGGRCARGTMA (SEQ ID NO: 17121) | |
| 163 | A + AAATYATAGGRCARGTMA (SEQ ID NO: 17122) | |
| 163 | AAAATYATAGGRCAR + GTMA (SEQ ID NO: 17123) | |
| 163 | AAAATYATAG + GRCARGTMA (SEQ ID NO: 17124) | |
| 163 | AAAATYATAGG + RCARGTMA (SEQ ID NO: 17125) | |
| 163 | AAAATYATAGGRCA + RGTMA (SEQ ID NO: 17126) | |
| 163 | AAAA + TYAT + AG + GRCARGTMA (SEQ ID NO: 17127) | |
| 163 | AA + AATYAT + AG + GRCARGTMA (SEQ ID NO: 17128) | |
| 163 | AAAAT + YAT + AG + GRCARGTMA (SEQ ID NO: 17129) | |
| 163 | AAAATY + AT + AG + GRCARGTMA (SEQ ID NO: 17130) | |
| 163 | AAAATYAT + AG + G + RCARGTMA (SEQ ID NO: 17131) | |
| 163 | AAAATYAT + AG + GRC + ARGTMA (SEQ ID NO: 17132) | |
| 163 | AAAATYAT + AG + GR + CARGTMA (SEQ ID NO: 17133) | |
| 163 | AAAATYAT + AG + GRCA + RGTMA (SEQ ID NO: 17134) | |
| 163 | A + AATYATAGGRCARGTM (SEQ ID NO: 17135) | |
| 163 | AA + ATYATAGGRCARGTM (SEQ ID NO: 17136) | |
| 163 | AAATYA + TAGGRCARGTM (SEQ ID NO: 17137) | |
| 163 | +AAATYATAGGRCARGTM (SEQ ID NO: 17138) | |
| 163 | AAATYATAGGRCAR + GTM (SEQ ID NO: 17139) | |
| 163 | AAATYATAG + GRCARGTM (SEQ ID NO: 17140) | |
| 163 | AAATYATAGG + RCARGTM (SEQ ID NO: 17141) | |
| 163 | AAATYATAGGRCA + RGTM (SEQ ID NO: 17142) | |
| 163 | AAA + TYAT + AG + GRCARGTM (SEQ ID NO: 17143) | |
| 163 | A + AATYAT + AG + GRCARGTM (SEQ ID NO: 17144) | |
| 163 | AAAT + YAT + AG + GRCARGTM (SEQ ID NO: 17145) | |
| 163 | AAATY + AT + AG + GRCARGTM (SEQ ID NO: 17146) | |
| 163 | AAATYAT + AG + G + RCARGTM (SEQ ID NO: 17147) | |
| 163 | AAATYAT + AG + GRC + ARGTM (SEQ ID NO: 17148) | |
| 163 | AAATYAT + AG + GR + CARGTM (SEQ ID NO: 17149) | |
| 163 | AAATYAT + AG + GRCA + RGTM (SEQ ID NO: 17150) | |
| 163 | A + AATYATAGGRCARG (SEQ ID NO: 17151) | |
| 163 | AA + ATYATAGGRCARG (SEQ ID NO: 17152) | |
| 163 | AAATYA + TAGGRCARG (SEQ ID NO: 17153) | |
| 163 | +AAATYATAGGRCARG (SEQ ID NO: 17154) | |
| 163 | AAATYATAGGRCAR + G (SEQ ID NO: 17155) | |
| 163 | AAATYATAG + GRCARG (SEQ ID NO: 17156) | |
| 163 | AAATYATAGG + RCARG (SEQ ID NO: 17157) | |
| 163 | AAATYATAGGRCA + RG (SEQ ID NO: 17158) | |
| 163 | AAA + TYAT + AG + GRCARG (SEQ ID NO: 17159) | |
| 163 | A + AATYAT + AG + GRCARG (SEQ ID NO: 17160) | |
| 163 | AAAT + YAT + AG + GRCARG (SEQ ID NO: 17161) | |
| 163 | AAATY + AT + AG + GRCARG (SEQ ID NO: 17162) | |
| 163 | AAATYAT + AG + G + RCARG (SEQ ID NO: 17163) | |
| 163 | AAATYAT + AG + GRC + ARG (SEQ ID NO: 17164) | |
| 163 | AAATYAT + AG + GR + CARG (SEQ ID NO: 17165) | |

TABLE 13-continued

| 163 | AAATYAT + AG + GRCA + RG (SEQ ID NO: 17166) |
| 163 | A + AATYATAGGRCA (SEQ ID NO: 17167) |
| 163 | AA + ATYATAGGRCA (SEQ ID NO: 17168) |
| 163 | AAATYA + TAGGRCA (SEQ ID NO: 17169) |
| 163 | +AAATYATAGGRCA (SEQ ID NO: 17170) |
| 163 | AAATYATAGGRCAR (SEQ ID NO: 17171) |
| 163 | AAATYATAG + GRCA (SEQ ID NO: 17172) |
| 163 | AAATYATAGG + RCA (SEQ ID NO: 17173) |
| 163 | AAATYATAGGRCA (SEQ ID NO: 17174) |
| 163 | AAA + TYAT + AG + GRCA (SEQ ID NO: 17175) |
| 163 | A + AATYAT + AG + GRCA (SEQ ID NO: 17176) |
| 163 | AAAT + YAT + AG + GRCA (SEQ ID NO: 17177) |
| 163 | AAATY + AT + AG + GRCA (SEQ ID NO: 17178) |
| 163 | AAATYAT + AG + G + RCA (SEQ ID NO: 17179) |
| 163 | AAATYAT + AG + GRC + A (SEQ ID NO: 17180) |
| 163 | AAATYAT + AG + GR + CA (SEQ ID NO: 17181) |
| 163 | AAATYAT + AG + GRCA (SEQ ID NO: 17182) |
| 163 | AAAATYATAGGRCARGTMA (SEQ ID NO: 17183) |
| 163 | AAATYATAGGRCARGTM (SEQ ID NO: 17184) |
| 163 | AAATYATAGGRCARG (SEQ ID NO: 17185) |
| 163 | AAATYATAGGRCA (SEQ ID NO: 17186) |
| 163 | ATTATAGGRCAGGTA (SEQ ID NO: 17187) |
| 230 | TACAGRGA + CAGCAGAGAYC (SEQ ID NO: 17188) |
| 230 | TACAGR + GACAGCAGAGAYC (SEQ ID NO: 17189) |
| 230 | TA + CAGRGACAGCAGAGAYC (SEQ ID NO: 17190) |
| 230 | T + ACAGRGACAGCAGAGAYC (SEQ ID NO: 17191) |
| 230 | TACAGRGACA + GCAGAGAYC (SEQ ID NO: 17192) |
| 230 | TACAGRGACAG + CAGAGAYC (SEQ ID NO: 17193) |
| 230 | TACAGRGACAGC + AGAGAYC (SEQ ID NO: 17194) |
| 230 | TACAGRGACAGCAGAGA + YC (SEQ ID NO: 17195) |
| 230 | TACAGRG + A + CA + GCAGAGAYC (SEQ ID NO: 17196) |
| 230 | TACAGR + GA + CA + GCAGAGAYC (SEQ ID NO: 17197) |
| 230 | TAC + AGRGA + CA + GCAGAGAYC (SEQ ID NO: 17198) |
| 230 | TACAG + RGA + CA + GCAGAGAYC (SEQ ID NO: 17199) |
| 230 | TACAGRGA + CA + GC + AGAGAYC (SEQ ID NO: 17200) |
| 230 | TACAGRGA + CA + GCAGAGAY + C (SEQ ID NO: 17201) |
| 230 | TACAGRGA + CA + G + CAGAGAYC (SEQ ID NO: 17202) |
| 230 | TACAGRGA + CA + GCAGA + GAYC (SEQ ID NO: 17203) |
| 230 | ACAGRGA + CAGCAGAGAY (SEQ ID NO: 17204) |
| 230 | ACAGR + GACAGCAGAGAY (SEQ ID NO: 17205) |
| 230 | A + CAGRGACAGCAGAGAY (SEQ ID NO: 17206) |
| 230 | +ACAGRGACAGCAGAGAY (SEQ ID NO: 17207) |
| 230 | ACAGRGACA + GCAGAGAY (SEQ ID NO: 17208) |
| 230 | ACAGRGACAG + CAGAGAY (SEQ ID NO: 17209) |
| 230 | ACAGRGACAGC + AGAGAY (SEQ ID NO: 17210) |
| 230 | ACAGRGACAGCAGAGA + Y (SEQ ID NO: 17211) |
| 230 | ACAGRG + A + CA + GCAGAGAY (SEQ ID NO: 17212) |
| 230 | ACAGR + GA + CA + GCAGAGAY (SEQ ID NO: 17213) |
| 230 | AC + AGRGA + CA + GCAGAGAY (SEQ ID NO: 17214) |
| 230 | ACAG + RGA + CA + GCAGAGAY (SEQ ID NO: 17215) |
| 230 | ACAGRGA + CA + GC + AGAGAY (SEQ ID NO: 17216) |
| 230 | ACAGRGA + CA + GCAGAGAY (SEQ ID NO: 17217) |
| 230 | ACAGRGA + CA + G + CAGAGAY (SEQ ID NO: 17218) |
| 230 | ACAGRGA + CA + GCAGA + GAY (SEQ ID NO: 17219) |
| 230 | ACAGRGA + CAGCAGAG (SEQ ID NO: 17220) |
| 230 | ACAGR + GACAGCAGAG (SEQ ID NO: 17221) |
| 230 | A + CAGRGACAGCAGAG (SEQ ID NO: 17222) |
| 230 | +ACAGRGACAGCAGAG (SEQ ID NO: 17223) |
| 230 | ACAGRGACA + GCAGAG (SEQ ID NO: 17224) |
| 230 | ACAGRGACAG + CAGAG (SEQ ID NO: 17225) |
| 230 | ACAGRGACAGC + AGAG (SEQ ID NO: 17226) |
| 230 | ACAGRGACAGCAGAGA (SEQ ID NO: 17227) |
| 230 | ACAGRG + A + CA + GCAGAG (SEQ ID NO: 17228) |
| 230 | ACAGR + GA + CA + GCAGAG (SEQ ID NO: 17229) |
| 230 | AC + AGRGA + CA + GCAGAG (SEQ ID NO: 17230) |
| 230 | ACAG + RGA + CA + GCAGAG (SEQ ID NO: 17231) |
| 230 | ACAGRGA + CA + GC + AGAG (SEQ ID NO: 17232) |
| 230 | ACAGRGA + CA + GCAGAGA (SEQ ID NO: 17233) |
| 230 | ACAGRGA + CA + G + CAGAG (SEQ ID NO: 17234) |
| 230 | ACAGRGA + CA + GCAGA + G (SEQ ID NO: 17235) |
| 230 | ACAGRGA + CAGCAG (SEQ ID NO: 17236) |
| 230 | ACAGR + GACAGCAG (SEQ ID NO: 17237) |
| 230 | A + CAGRGACAGCAG (SEQ ID NO: 17238) |

TABLE 13-continued

| | |
|---|---|
| 230 | +ACAGRGACAGCAG (SEQ ID NO: 17239) |
| 230 | ACAGRGACA + GCAG (SEQ ID NO: 17240) |
| 230 | ACAGRGACAG + CAG (SEQ ID NO: 17241) |
| 230 | ACAGRGACAGC + AG (SEQ ID NO: 17242) |
| 230 | ACAGRGACAGCAGA (SEQ ID NO: 17243) |
| 230 | ACAGRG + A + CA + GCAG (SEQ ID NO: 17244) |
| 230 | ACAGR + GA + CA + GCAG (SEQ ID NO: 17245) |
| 230 | AC + AGRGA + CA + GCAG (SEQ ID NO: 17246) |
| 230 | ACAG + RGA + CA + GCAG (SEQ ID NO: 17247) |
| 230 | ACAGRGA + CA + GC + AG (SEQ ID NO: 17248) |
| 230 | ACAGRGA + CA + GCAGA (SEQ ID NO: 17249) |
| 230 | ACAGRGA + CA + G + CAG (SEQ ID NO: 17250) |
| 230 | TACAGRGACAGCAGAGAYC (SEQ ID NO: 17251) |
| 230 | ACAGRGACAGCAGAGAY (SEQ ID NO: 17252) |
| 230 | ACAGRGACAGCAGAG (SEQ ID NO: 17253) |
| 230 | ACAGRGACAGCAG (SEQ ID NO: 17254) |
| 230 | AGGGACAGCAGAGAC (SEQ ID NO: 17255) |
| 263 | TRCCAAG + RAGRAAAGYAAA (SEQ ID NO: 17256) |
| 263 | TRCCAA + GRAGRAAAGYAAA (SEQ ID NO: 17257) |
| 263 | TR + CCAAGRAGRAAAGYAAA (SEQ ID NO: 17258) |
| 263 | TRC + CAAGRAGRAAAGYAAA (SEQ ID NO: 17259) |
| 263 | TRCCAAGRAGRAAA + GYAAA (SEQ ID NO: 17260) |
| 263 | TRCCAAGRAGRAAAGY + AAA (SEQ ID NO: 17261) |
| 263 | TRCCAAGRAGRAA + AGYAAA (SEQ ID NO: 17262) |
| 263 | TRCCAAGRAGR + AAAGYAAA (SEQ ID NO: 17263) |
| 263 | TR + CCAAGR + AG + RAAAGYAAA (SEQ ID NO: 17264) |
| 263 | TRC + CAAGR + AG + RAAAGYAAA (SEQ ID NO: 17265) |
| 263 | TRCCAA + GR + AG + RAAAGYAAA (SEQ ID NO: 17266) |
| 263 | TRCCAAG + R + AG + RAAAGYAAA (SEQ ID NO: 17267) |
| 263 | TRCCAAGR + AG + RAAAG + YAAA (SEQ ID NO: 17268) |
| 263 | TRCCAAGR + AG + RAA + AGYAAA (SEQ ID NO: 17269) |
| 263 | TRCCAAGR + AG + RAAA + GYAAA (SEQ ID NO: 17270) |
| 263 | TRCCAAGR + AG + R + AAAGYAAA (SEQ ID NO: 17271) |
| 263 | RCCAAG + RAGRAAAGYAA (SEQ ID NO: 17272) |
| 263 | RCCAA + GRAGRAAAGYAA (SEQ ID NO: 17273) |
| 263 | R + CCAAGRAGRAAAGYAA (SEQ ID NO: 17274) |
| 263 | RC + CAAGRAGRAAAGYAA (SEQ ID NO: 17275) |
| 263 | RCCAAGRAGRAAA + GYAA (SEQ ID NO: 17276) |
| 263 | RCCAAGRAGRAAAGY + AA (SEQ ID NO: 17277) |
| 263 | RCCAAGRAGRAA + AGYAA (SEQ ID NO: 17278) |
| 263 | RCCAAGRAGR + AAAGYAA (SEQ ID NO: 17279) |
| 263 | R + CCAAGR + AG + RAAAGYAA (SEQ ID NO: 17280) |
| 263 | RC + CAAGR + AG + RAAAGYAA (SEQ ID NO: 17281) |
| 263 | RCCAA + GR + AG + RAAAGYAA (SEQ ID NO: 17282) |
| 263 | RCCAAG + R + AG + RAAAGYAA (SEQ ID NO: 17283) |
| 263 | RCCAAGR + AG + RAAAG + YAA (SEQ ID NO: 17284) |
| 263 | RCCAAGR + AG + RAA + AGYAA (SEQ ID NO: 17285) |
| 263 | RCCAAGR + AG + RAAA + GYAA (SEQ ID NO: 17286) |
| 263 | RCCAAGR + AG + R + AAAGYAA (SEQ ID NO: 17287) |
| 263 | RCCAAG + RAGRAAAGY (SEQ ID NO: 17288) |
| 263 | RCCAA + GRAGRAAAGY (SEQ ID NO: 17289) |
| 263 | R + CCAAGRAGRAAAGY (SEQ ID NO: 17290) |
| 263 | RC + CAAGRAGRAAAGY (SEQ ID NO: 17291) |
| 263 | RCCAAGRAGRAAA + GY (SEQ ID NO: 17292) |
| 263 | RCCAAGRAGRAAAGY (SEQ ID NO: 17293) |
| 263 | RCCAAGRAGRAA + AGY (SEQ ID NO: 17294) |
| 263 | RCCAAGRAGR + AAAGY (SEQ ID NO: 17295) |
| 263 | R + CCAAGR + AG + RAAAGY (SEQ ID NO: 17296) |
| 263 | RC + CAAGR + AG + RAAAGY (SEQ ID NO: 17297) |
| 263 | RCCAA + GR + AG + RAAAGY (SEQ ID NO: 17298) |
| 263 | RCCAAG + R + AG + RAAAGY (SEQ ID NO: 17299) |
| 263 | RCCAAGR + AG + RAAAG + Y (SEQ ID NO: 17300) |
| 263 | RCCAAGR + AG + RAA + AGY (SEQ ID NO: 17301) |
| 263 | RCCAAGR + AG + RAAA + GY (SEQ ID NO: 17302) |
| 263 | RCCAAGR + AG + R + AAAGY (SEQ ID NO: 17303) |
| 263 | RCCAAG + RAGRAAA (SEQ ID NO: 17304) |
| 263 | RCCAA + GRAGRAAA (SEQ ID NO: 17305) |
| 263 | R + CCAAGRAGRAAA (SEQ ID NO: 17306) |
| 263 | RC + CAAGRAGRAAA (SEQ ID NO: 17307) |
| 263 | RCCAAGRAGRAAA (SEQ ID NO: 17308) |
| 263 | RCCAAGRAGRAAAG (SEQ ID NO: 17309) |
| 263 | RCCAAGRAGRAA + A (SEQ ID NO: 17310) |

TABLE 13-continued

| Codon | Mutant Probe (5' to 3') |
|---|---|
| 263 | RCCAAGRAGR + AAA (SEQ ID NO: 17311) |
| 263 | R + CCAAGR + AG + RAAA (SEQ ID NO: 17312) |
| 263 | RC + CAAGR + AG + RAAA (SEQ ID NO: 17313) |
| 263 | RCCAA + GR + AG + RAAA (SEQ ID NO: 17314) |
| 263 | RCCAAG + R + AG + RAAA (SEQ ID NO: 17315) |
| 263 | RCCAAGR + AG + RAAAG (SEQ ID NO: 17316) |
| 263 | RCCAAGR + AG + RAA + A (SEQ ID NO: 17317) |
| 263 | RCCAAGR + AG + RAAA (SEQ ID NO: 17318) |
| 263 | RCCAAGR + AG + R + AAA (SEQ ID NO: 17319) |
| 263 | TRCCAAGRAGRAAAGYAAA (SEQ ID NO: 17320) |
| 263 | RCCAAGRAGRAAAGYAA (SEQ ID NO: 17321) |
| 263 | RCCAAGRAGRAAAGY (SEQ ID NO: 17322) |
| 263 | RCCAAGRAGRAAA (SEQ ID NO: 17323) |
| 263 | CCAAGAAGRAAAGCA (SEQ ID NO: 17324) |

| Codon | Mutant Probe (5' to 3') |
|---|---|
| 51 | AGCCATGTATGGACA (SEQ ID NO: 17325) |
| 66 | YTAGAYTG + Y + CACAYYTAG (SEQ ID NO: 17326) |
| 66 | YTAGAYT + GYCACAYYTAG (SEQ ID NO: 17327) |
| 66 | Y + TAGAYTGYCACAYYTAG (SEQ ID NO: 17328) |
| 66 | YTAGAY + TGYCACAYYTAG (SEQ ID NO: 17329) |
| 66 | YT + AGAYTGYCACAYYTAG (SEQ ID NO: 17330) |
| 66 | YTAGAYTGYCACA + YYTAG (SEQ ID NO: 17331) |
| 66 | YTAGAYTGYCACAYY + TAG (SEQ ID NO: 17332) |
| 66 | YTAGAYTGY + CACAYYTAG (SEQ ID NO: 17333) |
| 66 | YTAGAYTGYCAC + AYYTAG (SEQ ID NO: 17334) |
| 66 | YTAG + AYTG + Y + CACAYYTAG (SEQ ID NO: 17335) |
| 66 | YT + AGAYTG + Y + CACAYYTAG (SEQ ID NO: 17336) |
| 66 | YTAGAYT + G + Y + CACAYYTAG (SEQ ID NO: 17337) |
| 66 | YTA + GAYTG + Y + CACAYYTAG (SEQ ID NO: 17338) |
| 66 | YTAGAYTG + Y + CAC + AYYTAG (SEQ ID NO: 17339) |
| 66 | YTAGAYTG + Y + CA + CAYYTAG (SEQ ID NO: 17340) |
| 66 | YTAGAYTG + Y + CACAY + YTAG (SEQ ID NO: 17341) |
| 66 | YTAGAYTG + Y + CACAYY + TAG (SEQ ID NO: 17342) |
| 66 | TAGAYTGY + A + ACAYYTAGA (SEQ ID NO: 17343) |
| 66 | TAGAYT + GYAACAYYTAGA (SEQ ID NO: 17344) |
| 66 | TAGA + YTGYAACAYYTAGA (SEQ ID NO: 17345) |
| 66 | TAGAYTG + YAACAYYTAGA (SEQ ID NO: 17346) |
| 66 | TA + GAYTGYAACAYYTAGA (SEQ ID NO: 17347) |
| 66 | TAGAYTGYAAC + AYYTAGA (SEQ ID NO: 17348) |
| 66 | TAGAYTGYAACAYYT + AGA (SEQ ID NO: 17349) |
| 66 | TAGAYTGYA + ACAYYTAGA (SEQ ID NO: 17350) |
| 66 | TAGAYTGYAACAY + YTAGA (SEQ ID NO: 17351) |
| 66 | TAGAYT + GY + A + ACAYYTAGA (SEQ ID NO: 17352) |
| 66 | TAGAY + TGY + A + ACAYYTAGA (SEQ ID NO: 17353) |
| 66 | T + AGAYTGY + A + ACAYYTAGA (SEQ ID NO: 17354) |
| 66 | TA + GAYTGY + A + ACAYYTAGA (SEQ ID NO: 17355) |
| 66 | TAGAYTGY + A + ACAYYTA + GA (SEQ ID NO: 17356) |
| 66 | TAGAYTGY + A + ACAYYT + AGA (SEQ ID NO: 17357) |
| 66 | TAGAYTGY + A + ACA + YYTAGA (SEQ ID NO: 17358) |
| 66 | TAGAYTGY + A + ACAYY + TAGA (SEQ ID NO: 17359) |
| 66 | TAGAY + TGYAACAYYTAGA (SEQ ID NO: 17360) |
| 66 | TAGAYTGYAACAYYTA + GA (SEQ ID NO: 17361) |
| 66 | TAGAYTGYAA + CAYYTAGA (SEQ ID NO: 17362) |
| 66 | TAGAYTGYAACA + YYTAGA (SEQ ID NO: 17363) |
| 66 | TAGA + YTGY + A + ACAYYTAGA (SEQ ID NO: 17364) |
| 66 | TAGAYTG + Y + A + ACAYYTAGA (SEQ ID NO: 17365) |
| 66 | TAGAYTGY + A + A + CAYYTAGA (SEQ ID NO: 17366) |
| 66 | TAGAYTGY + A + ACAY + YTAGA (SEQ ID NO: 17367) |
| 66 | TAGAYTG + Y + CACAYYTAG (SEQ ID NO: 17368) |
| 66 | TAGAYT + GYCACAYYTAG (SEQ ID NO: 17369) |
| 66 | +TAGAYTGYCACAYYTAG (SEQ ID NO: 17370) |
| 66 | TAGAY + TGYCACAYYTAG (SEQ ID NO: 17371) |
| 66 | T + AGAYTGYCACAYYTAG (SEQ ID NO: 17372) |
| 66 | TAGAYTGYCACA + YYTAG (SEQ ID NO: 17373) |
| 66 | TAGAYTGYCACAYY + TAG (SEQ ID NO: 17374) |
| 66 | TAGAYTGY + CACAYYTAG (SEQ ID NO: 17375) |
| 66 | TAGAYTGYCAC + AYYTAG (SEQ ID NO: 17376) |
| 66 | TAG + AYTG + Y + CACAYYTAG (SEQ ID NO: 17377) |
| 66 | T + AGAYTG + Y + CACAYYTAG (SEQ ID NO: 17378) |

TABLE 13-continued

| | |
|---|---|
| 66 | TAGAYT + G + Y + CACAYYTAG (SEQ ID NO: 17379) |
| 66 | TA + GAYTG + Y + CACAYYTAG (SEQ ID NO: 17380) |
| 66 | TAGAYTG + Y + CAC + AYYTAG (SEQ ID NO: 17381) |
| 66 | TAGAYTG + Y + CA + CAYYTAG (SEQ ID NO: 17382) |
| 66 | TAGAYTG + Y + CACAY + YTAG (SEQ ID NO: 17383) |
| 66 | TAGAYTG + Y + CACAYY + TAG (SEQ ID NO: 17384) |
| 66 | AGAYTGY + A + ACAYYTAGA (SEQ ID NO: 17385) |
| 66 | AGAYT + GYAACAYYTAGA (SEQ ID NO: 17386) |
| 66 | AGA + YTGYAACAYYTAGA (SEQ ID NO: 17387) |
| 66 | AGAYTG + YAACAYYTAGA (SEQ ID NO: 17388) |
| 66 | A + GAYTGYAACAYYTAGA (SEQ ID NO: 17389) |
| 66 | AGAYTGYAAC + AYYTAGA (SEQ ID NO: 17390) |
| 66 | AGAYTGYAACAYYT + AGA (SEQ ID NO: 17391) |
| 66 | AGAYTGYA + ACAYYTAGA (SEQ ID NO: 17392) |
| 66 | AGAYTGYAACAY + YTAGA (SEQ ID NO: 17393) |
| 66 | AGAYT + GY + A + ACAYYTAGA (SEQ ID NO: 17394) |
| 66 | AGAY + TGY + A + ACAYYTAGA (SEQ ID NO: 17395) |
| 66 | +AGAYTGY + A + ACAYYTAGA (SEQ ID NO: 17396) |
| 66 | A + GAYTGY + A + ACAYYTAGA (SEQ ID NO: 17397) |
| 66 | AGAYTGY + A + ACAYYTA + GA (SEQ ID NO: 17398) |
| 66 | AGAYTGY + A + ACAYYT + AGA (SEQ ID NO: 17399) |
| 66 | AGAYTGY + A + ACA + YYTAGA (SEQ ID NO: 17400) |
| 66 | AGAYTGY + A + ACAYY + TAGA (SEQ ID NO: 17401) |
| 66 | AGAY + TGYAACAYYTAGA (SEQ ID NO: 17402) |
| 66 | AGAYTGYAACAYYTA + GA (SEQ ID NO: 17403) |
| 66 | AGAYTGYAA + CAYYTAGA (SEQ ID NO: 17404) |
| 66 | AGAYTGYAACA + YYTAGA (SEQ ID NO: 17405) |
| 66 | AGA + YTGY + A + ACAYYTAGA (SEQ ID NO: 17406) |
| 66 | AGAYTG + Y + A + ACAYYTAGA (SEQ ID NO: 17407) |
| 66 | AGAYTGY + A + A + CAYYTAGA (SEQ ID NO: 17408) |
| 66 | AGAYTGY + A + ACAY + YTAGA (SEQ ID NO: 17409) |
| 66 | TAGAYTG + Y + CACAYYT (SEQ ID NO: 17410) |
| 66 | TAGAYT + GYCACAYYT (SEQ ID NO: 17411) |
| 66 | +TAGAYTGYCACAYYT (SEQ ID NO: 17412) |
| 66 | TAGAY + TGYCACAYYT (SEQ ID NO: 17413) |
| 66 | T + AGAYTGYCACAYYT (SEQ ID NO: 17414) |
| 66 | TAGAYTGYCACA + YYT (SEQ ID NO: 17415) |
| 66 | TAGAYTGYCACAYY + T (SEQ ID NO: 17416) |
| 66 | TAGAYTGY + CACAYYT (SEQ ID NO: 17417) |
| 66 | TAGAYTGYCAC + AYYT (SEQ ID NO: 17418) |
| 66 | TAG + AYTG + Y + CACAYYT (SEQ ID NO: 17419) |
| 66 | T + AGAYTG + Y + CACAYYT (SEQ ID NO: 17420) |
| 66 | TAGAYT + G + Y + CACAYYT (SEQ ID NO: 17421) |
| 66 | TA + GAYTG + Y + CACAYYT (SEQ ID NO: 17422) |
| 66 | TAGAYTG + Y + CAC + AYYT (SEQ ID NO: 17423) |
| 66 | TAGAYTG + Y + CA + CAYYT (SEQ ID NO: 17424) |
| 66 | TAGAYTG + Y + CACAY + YT (SEQ ID NO: 17425) |
| 66 | TAGAYTG + Y + CACAYY + T (SEQ ID NO: 17426) |
| 66 | AGAYTGY + A + ACAYYTA (SEQ ID NO: 17427) |
| 66 | AGAYT + GYAACAYYTA (SEQ ID NO: 17428) |
| 66 | AGA + YTGYAACAYYTA (SEQ ID NO: 17429) |
| 66 | AGAYTG + YAACAYYTA (SEQ ID NO: 17430) |
| 66 | A + GAYTGYAACAYYTA (SEQ ID NO: 17431) |
| 66 | AGAYTGYAAC + AYYTA (SEQ ID NO: 17432) |
| 66 | AGAYTGYAACAYYT + A (SEQ ID NO: 17433) |
| 66 | AGAYTGYA + ACAYYTA (SEQ ID NO: 17434) |
| 66 | AGAYTGYAACAY + YTA (SEQ ID NO: 17435) |
| 66 | AGAYT + GY + A + ACAYYTA (SEQ ID NO: 17436) |
| 66 | AGAY + TGY + A + ACAYYTA (SEQ ID NO: 17437) |
| 66 | +AGAYTGY + A + ACAYYTA (SEQ ID NO: 17438) |
| 66 | A + GAYTGY + A + ACAYYTA (SEQ ID NO: 17439) |
| 66 | AGAYTGY + A + ACAYYTA (SEQ ID NO: 17440) |
| 66 | AGAYTGY + A + ACAYYT + A (SEQ ID NO: 17441) |
| 66 | AGAYTGY + A + ACA + YYTA (SEQ ID NO: 17442) |
| 66 | AGAYTGY + A + ACAYY + TA (SEQ ID NO: 17443) |
| 66 | AGAY + TGYAACAYYTA (SEQ ID NO: 17444) |
| 66 | AGAYTGYAACAYYTA (SEQ ID NO: 17445) |
| 66 | AGAYTGYAA + CAYYTA (SEQ ID NO: 17446) |
| 66 | AGAYTGYAACA + YYTA (SEQ ID NO: 17447) |
| 66 | AGA + YTGY + A + ACAYYTA (SEQ ID NO: 17448) |
| 66 | AGAYTG + Y + A + ACAYYTA (SEQ ID NO: 17449) |

TABLE 13-continued

| | |
|---|---|
| 66 | AGAYTGY + A + A + CAYYTA (SEQ ID NO: 17450) |
| 66 | AGAYTGY + A + ACAY + YTA (SEQ ID NO: 17451) |
| 66 | TAGAYTG + Y + CACAY (SEQ ID NO: 17452) |
| 66 | TAGAYT + GYCACAY (SEQ ID NO: 17453) |
| 66 | +TAGAYTGYCACAY (SEQ ID NO: 17454) |
| 66 | TAGAY + TGYCACAY (SEQ ID NO: 17455) |
| 66 | T + AGAYTGYCACAY (SEQ ID NO: 17456) |
| 66 | TAGAYTGYCACA + Y (SEQ ID NO: 17457) |
| 66 | TAGAYTGYCACAYY (SEQ ID NO: 17458) |
| 66 | TAGAYTGY + CACAY (SEQ ID NO: 17459) |
| 66 | TAGAYTGYCAC + AY (SEQ ID NO: 17460) |
| 66 | TAG + AYTG + Y + CACAY (SEQ ID NO: 17461) |
| 66 | T + AGAYTG + Y + CACAY (SEQ ID NO: 17462) |
| 66 | TAGAYT + G + Y + CACAY (SEQ ID NO: 17463) |
| 66 | TA + GAYTG + Y + CACAY (SEQ ID NO: 17464) |
| 66 | TAGAYTG + Y + CAC + AY (SEQ ID NO: 17465) |
| 66 | TAGAYTG + Y + CA + CAY (SEQ ID NO: 17466) |
| 66 | TAGAYTG + Y + CACAY (SEQ ID NO: 17467) |
| 66 | TAGAYTG + Y + CACAYY (SEQ ID NO: 17468) |
| 66 | AGAYTGY + A + ACAYY (SEQ ID NO: 17469) |
| 66 | AGAYT + GYAACAYY (SEQ ID NO: 17470) |
| 66 | AGA + YTGYAACAYY (SEQ ID NO: 17471) |
| 66 | AGAYTG + YAACAYY (SEQ ID NO: 17472) |
| 66 | A + GAYTGYAACAYY (SEQ ID NO: 17473) |
| 66 | AGAYTGYAAC + AYY (SEQ ID NO: 17474) |
| 66 | AGAYTGYAACAYYT (SEQ ID NO: 17475) |
| 66 | AGAYTGYA + ACAYY (SEQ ID NO: 17476) |
| 66 | AGAYTGYAACAY + Y (SEQ ID NO: 17477) |
| 66 | AGAYT + GY + A + ACAYY (SEQ ID NO: 17478) |
| 66 | AGAY + TGY + A + ACAYY (SEQ ID NO: 17479) |
| 66 | +AGAYTGY + A + ACAYY (SEQ ID NO: 17480) |
| 66 | A + GAYTGY + A + ACAYY (SEQ ID NO: 17481) |
| 66 | AGAYTGY + A + ACAYYT (SEQ ID NO: 17482) |
| 66 | AGAYTGY + A + ACA + YY (SEQ ID NO: 17483) |
| 66 | AGAYTGY + A + ACAYY (SEQ ID NO: 17484) |
| 66 | AGAY + TGYAACAYY (SEQ ID NO: 17485) |
| 66 | AGAYTGYAA + CAYY (SEQ ID NO: 17486) |
| 66 | AGAYTGYAACA + YY (SEQ ID NO: 17487) |
| 66 | AGA + YTGY + A + ACAYY (SEQ ID NO: 17488) |
| 66 | AGAYTG + Y + A + ACAYY (SEQ ID NO: 17489) |
| 66 | AGAYTGY + A + A + CAYY (SEQ ID NO: 17490) |
| 66 | AGAYTGY + A + ACAY + Y (SEQ ID NO: 17491) |
| 66 | YTAGAYTGYCACAYYTAG (SEQ ID NO: 17492) |
| 66 | TAGAYTGYAACAYYTAGA (SEQ ID NO: 17493) |
| 66 | TAGAYTGYCACAYYTAG (SEQ ID NO: 17494) |
| 66 | AGAYTGYAACAYYTAGA (SEQ ID NO: 17495) |
| 66 | TAGAYTGYCACAYYT (SEQ ID NO: 17496) |
| 66 | AGAYTGYAACAYYTA (SEQ ID NO: 17497) |
| 66 | TAGAYTGYCACAY (SEQ ID NO: 17498) |
| 66 | AGAYTGYAACAYY (SEQ ID NO: 17499) |
| 66 | TAAATGKATACAATC (SEQ ID NO: 17500) |
| 66 | TAAATGKGCACAATC (SEQ ID NO: 17501) |
| 66 | TAAATGTTTACAATC (SEQ ID NO: 17502) |
| 74 | AAARTHAT + Y + TRGTAGCAG (SEQ ID NO: 17503) |
| 74 | AAA + RTHATYTRGTAGCAG (SEQ ID NO: 17504) |
| 74 | A + AARTHATYTRGTAGCAG (SEQ ID NO: 17505) |
| 74 | AA + ARTHATYTRGTAGCAG (SEQ ID NO: 17506) |
| 74 | AAARTH + ATYTRGTAGCAG (SEQ ID NO: 17507) |
| 74 | AAARTHATYTR + GTAGCAG (SEQ ID NO: 17508) |
| 74 | AAARTHATYTRGTAGC + AG (SEQ ID NO: 17509) |
| 74 | AAARTHATYTRGTAG + CAG (SEQ ID NO: 17510) |
| 74 | AAARTHATYTRGTAGCA + G (SEQ ID NO: 17511) |
| 74 | AA + ARTHAT + Y + TRGTAGCAG (SEQ ID NO: 17512) |
| 74 | A + AARTHAT + Y + TRGTAGCAG (SEQ ID NO: 17513) |
| 74 | AAARTH + AT + Y + TRGTAGCAG (SEQ ID NO: 17514) |
| 74 | AAA + RTHAT + Y + TRGTAGCAG (SEQ ID NO: 17515) |
| 74 | AAARTHAT + Y + TRGT + AGCAG (SEQ ID NO: 17516) |
| 74 | AAARTHAT + Y + TRG + TAGCAG (SEQ ID NO: 17517) |
| 74 | AAARTHAT + Y + TRGTA + GCAG (SEQ ID NO: 17518) |
| 74 | AAARTHAT + Y + TR + GTAGCAG (SEQ ID NO: 17519) |
| 74 | AARTHAT + Y + TRGTAGCAG (SEQ ID NO: 17520) |
| 74 | AA + RTHATYTRGTAGCAG (SEQ ID NO: 17521) |
| 74 | +AARTHATYTRGTAGCAG (SEQ ID NO: 17522) |
| 74 | A + ARTHATYTRGTAGCAG (SEQ ID NO: 17523) |
| 74 | AARTH + ATYTRGTAGCAG (SEQ ID NO: 17524) |
| 74 | AARTHATYTR + GTAGCAG (SEQ ID NO: 17525) |

TABLE 13-continued

| | |
|---|---|
| 74 | AARTHATYTRGTAGC + AG (SEQ ID NO: 17526) |
| 74 | AARTHATYTRGTAG + CAG (SEQ ID NO: 17527) |
| 74 | AARTHATYTRGTAGCA + G (SEQ ID NO: 17528) |
| 74 | A + ARTHAT + Y + TRGTAGCAG (SEQ ID NO: 17529) |
| 74 | +AARTHAT + Y + TRGTAGCAG (SEQ ID NO: 17530) |
| 74 | AARTH + AT + Y + TRGTAGCAG (SEQ ID NO: 17531) |
| 74 | AA + RTHAT + Y + TRGTAGCAG (SEQ ID NO: 17532) |
| 74 | AARTHAT + Y + TRGT + AGCAG (SEQ ID NO: 17533) |
| 74 | AARTHAT + Y + TRG + TAGCAG (SEQ ID NO: 17534) |
| 74 | AARTHAT + Y + TRGTA + GCAG (SEQ ID NO: 17535) |
| 74 | AARTHAT + Y + TR + GTAGCAG (SEQ ID NO: 17536) |
| 74 | AARTHAT + Y + TRGTAGC (SEQ ID NO: 17537) |
| 74 | AA + RTHATYTRGTAGC (SEQ ID NO: 17538) |
| 74 | +AARTHATYTRGTAGC (SEQ ID NO: 17539) |
| 74 | A + ARTHATYTRGTAGC (SEQ ID NO: 17540) |
| 74 | AARTH + ATYTRGTAGC (SEQ ID NO: 17541) |
| 74 | AARTHATYTR + GTAGC (SEQ ID NO: 17542) |
| 74 | AARTHATYTRGTAGC (SEQ ID NO: 17543) |
| 74 | AARTHATYTRGTAG + C (SEQ ID NO: 17544) |
| 74 | AARTHATYTRGTAGCA (SEQ ID NO: 17545) |
| 74 | A + ARTHAT + Y + TRGTAGC (SEQ ID NO: 17546) |
| 74 | +AARTHAT + Y + TRGTAGC (SEQ ID NO: 17547) |
| 74 | AARTH + AT + Y + TRGTAGC (SEQ ID NO: 17548) |
| 74 | AA + RTHAT + Y + TRGTAGC (SEQ ID NO: 17549) |
| 74 | AARTHAT + Y + TRGT + AGC (SEQ ID NO: 17550) |
| 74 | AARTHAT + Y + TRG + TAGC (SEQ ID NO: 17551) |
| 74 | AARTHAT + Y + TRGTA + GC (SEQ ID NO: 17552) |
| 74 | AARTHAT + Y + TR + GTAGC (SEQ ID NO: 17553) |
| 74 | AARTHAT + Y + TRGTA (SEQ ID NO: 17554) |
| 74 | AA + RTHATYTRGTA (SEQ ID NO: 17555) |
| 74 | +AARTHATYTRGTA (SEQ ID NO: 17556) |
| 74 | A + ARTHATYTRGTA (SEQ ID NO: 17557) |
| 74 | AARTH + ATYTRGTA (SEQ ID NO: 17558) |
| 74 | AARTHATYTR + GTA (SEQ ID NO: 17559) |
| 74 | AARTHATYTRGTAG (SEQ ID NO: 17560) |
| 74 | A + ARTHAT + Y + TRGTA (SEQ ID NO: 17561) |
| 74 | +AARTHAT + Y + TRGTA (SEQ ID NO: 17562) |
| 74 | AARTH + AT + Y + TRGTA (SEQ ID NO: 17563) |
| 74 | AA + RTHAT + Y + TRGTA (SEQ ID NO: 17564) |
| 74 | AARTHAT + Y + TRGT + A (SEQ ID NO: 17565) |
| 74 | AARTHAT + Y + TRG + TA (SEQ ID NO: 17566) |
| 74 | AARTHAT + Y + TRGTA (SEQ ID NO: 17567) |
| 74 | AARTHAT + Y + TR + GTA (SEQ ID NO: 17568) |
| 74 | AAARTHATYTRGTAGCAG (SEQ ID NO: 17569) |
| 74 | AARTHATYTRGTAGCAG (SEQ ID NO: 17570) |
| 74 | AARTHATYTRGTAGC (SEQ ID NO: 17571) |
| 74 | AARTHATYTRGTA (SEQ ID NO: 17572) |
| 74 | AATTATCATGGTAGC (SEQ ID NO: 17573) |
| 92 | TYCCAGCA + G + RACAGGRCA (SEQ ID NO: 17574) |
| 92 | TYCCA + GCAGRACAGGRCA (SEQ ID NO: 17575) |
| 92 | TYCCAGCA + GRACAGGRCA (SEQ ID NO: 17576) |
| 92 | TYCCAG + CAGRACAGGRCA (SEQ ID NO: 17577) |
| 92 | TYCCAGC + AGRACAGGRCA (SEQ ID NO: 17578) |
| 92 | TYCCAGCAG + RACAGGRCA (SEQ ID NO: 17579) |
| 92 | TYCCAGCAGRACA + GGRCA (SEQ ID NO: 17580) |
| 92 | TYCCAGCAGRACAGG + RCA (SEQ ID NO: 17581) |
| 92 | TYCCAGCAGRA + CAGGRCA (SEQ ID NO: 17582) |
| 92 | TYCCA + GCA + G + RACAGGRCA (SEQ ID NO: 17583) |
| 92 | TYCC + AGCA + G + RACAGGRCA (SEQ ID NO: 17584) |
| 92 | TYC + CAGCA + G + RACAGGRCA (SEQ ID NO: 17585) |
| 92 | TY + CCAGCA + G + RACAGGRCA (SEQ ID NO: 17586) |
| 92 | TYCCAGCA + G + RAC + AGGRCA (SEQ ID NO: 17587) |
| 92 | TYCCAGCA + G + RACAGGRC + A (SEQ ID NO: 17588) |
| 92 | TYCCAGCA + G + RA + CAGGRCA (SEQ ID NO: 17589) |
| 92 | TYCCAGCA + G + R + ACAGGRCA (SEQ ID NO: 17590) |
| 92 | ATYCCAGC + A + ARACAGGRC (SEQ ID NO: 17591) |
| 92 | ATYCCA + GCAARACAGGRC (SEQ ID NO: 17592) |
| 92 | AT + YCCAGCAARACAGGRC (SEQ ID NO: 17593) |
| 92 | ATYCCAG + CAARACAGGRC (SEQ ID NO: 17594) |
| 92 | ATY + CCAGCAARACAGGRC (SEQ ID NO: 17595) |
| 92 | ATYCCAGCA + ARACAGGRC (SEQ ID NO: 17596) |
| 92 | ATYCCAGCAARA + CAGGRC (SEQ ID NO: 17597) |
| 92 | ATYCCAGCAARACAG + GRC (SEQ ID NO: 17598) |

TABLE 13-continued

| 92 | ATYCCAGCAA + RACAGGRC (SEQ ID NO: 17599) |
| 92 | ATYCCA + GC + A + ARACAGGRC (SEQ ID NO: 17600) |
| 92 | ATY + CCAGC + A + ARACAGGRC (SEQ ID NO: 17601) |
| 92 | AT + YCCAGC + A + ARACAGGRC (SEQ ID NO: 17602) |
| 92 | ATYC + CAGC + A + ARACAGGRC (SEQ ID NO: 17603) |
| 92 | ATYCCAGC + A + ARACAG + GRC (SEQ ID NO: 17604) |
| 92 | ATYCCAGC + A + ARACA + GGRC (SEQ ID NO: 17605) |
| 92 | ATYCCAGC + A + ARA + CAGGRC (SEQ ID NO: 17606) |
| 92 | ATYCCAGC + A + A + RACAGGRC (SEQ ID NO: 17607) |
| 92 | YCCAGCA + G + RACAGGRCA (SEQ ID NO: 17608) |
| 92 | YCCA + GCAGRACAGGRCA (SEQ ID NO: 17609) |
| 92 | YCCAGCA + GRACAGGRCA (SEQ ID NO: 17610) |
| 92 | YCCAG + CAGRACAGGRCA (SEQ ID NO: 17611) |
| 92 | YCCAGC + AGRACAGGRCA (SEQ ID NO: 17612) |
| 92 | YCCAGCAG + RACAGGRCA (SEQ ID NO: 17613) |
| 92 | YCCAGCAGRACA + GGRCA (SEQ ID NO: 17614) |
| 92 | YCCAGCAGRACAGG + RCA (SEQ ID NO: 17615) |
| 92 | YCCAGCAGRA + CAGGRCA (SEQ ID NO: 17616) |
| 92 | YCCA + GCA + G + RACAGGRCA (SEQ ID NO: 17617) |
| 92 | YCC + AGCA + G + RACAGGRCA (SEQ ID NO: 17618) |
| 92 | YC + CAGCA + G + RACAGGRCA (SEQ ID NO: 17619) |
| 92 | Y + CCAGCA + G + RACAGGRCA (SEQ ID NO: 17620) |
| 92 | YCCAGCA + G + RAC + AGGRCA (SEQ ID NO: 17621) |
| 92 | YCCAGCA + G + RACAGGRC + A (SEQ ID NO: 17622) |
| 92 | YCCAGCA + G + RA + CAGGRCA (SEQ ID NO: 17623) |
| 92 | YCCAGCA + G + R + ACAGGRCA (SEQ ID NO: 17624) |
| 92 | TYCCAGC + A + ARACAGGRC (SEQ ID NO: 17625) |
| 92 | TYCCA + GCAARACAGGRC (SEQ ID NO: 17626) |
| 92 | T + YCCAGCAARACAGGRC (SEQ ID NO: 17627) |
| 92 | TYCCAG + CAARACAGGRC (SEQ ID NO: 17628) |
| 92 | TY + CCAGCAARACAGGRC (SEQ ID NO: 17629) |
| 92 | TYCCAGCA + ARACAGGRC (SEQ ID NO: 17630) |
| 92 | TYCCAGCAARA + CAGGRC (SEQ ID NO: 17631) |
| 92 | TYCCAGCAARACAG + GRC (SEQ ID NO: 17632) |
| 92 | TYCCAGCAA + RACAGGRC (SEQ ID NO: 17633) |
| 92 | TYCCA + GC + A + ARACAGGRC (SEQ ID NO: 17634) |
| 92 | TY + CCAGC + A + ARACAGGRC (SEQ ID NO: 17635) |
| 92 | T + YCCAGC + A + ARACAGGRC (SEQ ID NO: 17636) |
| 92 | TYC + CAGC + A + ARACAGGRC (SEQ ID NO: 17637) |
| 92 | TYCCAGC + A + ARACAG + GRC (SEQ ID NO: 17638) |
| 92 | TYCCAGC + A + ARACA + GGRC (SEQ ID NO: 17639) |
| 92 | TYCCAGC + A + ARA + CAGGRC (SEQ ID NO: 17640) |
| 92 | TYCCAGC + A + A + RACAGGRC (SEQ ID NO: 17641) |
| 92 | YCCAGCA + G + RACAGGR (SEQ ID NO: 17642) |
| 92 | YCCA + GCAGRACAGGR (SEQ ID NO: 17643) |
| 92 | YCCAGCA + GRACAGGR (SEQ ID NO: 17644) |
| 92 | YCCAG + CAGRACAGGR (SEQ ID NO: 17645) |
| 92 | YCCAGC + AGRACAGGR (SEQ ID NO: 17646) |
| 92 | YCCAGCAG + RACAGGR (SEQ ID NO: 17647) |
| 92 | YCCAGCAGRACA + GGR (SEQ ID NO: 17648) |
| 92 | YCCAGCAGRACAGG + R (SEQ ID NO: 17649) |
| 92 | YCCAGCAGRA + CAGGR (SEQ ID NO: 17650) |
| 92 | YCCA + GCA + G + RACAGGR (SEQ ID NO: 17651) |
| 92 | YCC + AGCA + G + RACAGGR (SEQ ID NO: 17652) |
| 92 | YC + CAGCA + G + RACAGGR (SEQ ID NO: 17653) |
| 92 | Y + CCAGCA + G + RACAGGR (SEQ ID NO: 17654) |
| 92 | YCCAGCA + G + RAC + AGGR (SEQ ID NO: 17655) |
| 92 | YCCAGCA + G + RACAGGRC (SEQ ID NO: 17656) |
| 92 | YCCAGCA + G + RA + CAGGR (SEQ ID NO: 17657) |
| 92 | YCCAGCA + G + R + ACAGGR (SEQ ID NO: 17658) |
| 92 | TYCCAGC + A + ARACAGG (SEQ ID NO: 17659) |
| 92 | TYCCA + GCAARACAGG (SEQ ID NO: 17660) |
| 92 | T + YCCAGCAARACAGG (SEQ ID NO: 17661) |
| 92 | TYCCAG + CAARACAGG (SEQ ID NO: 17662) |
| 92 | TY + CCAGCAARACAGG (SEQ ID NO: 17663) |
| 92 | TYCCAGCA + ARACAGG (SEQ ID NO: 17664) |
| 92 | TYCCAGCAARA + CAGG (SEQ ID NO: 17665) |
| 92 | TYCCAGCAARACAG + G (SEQ ID NO: 17666) |

TABLE 13-continued

| | |
|---|---|
| 92 | TYCCAGCAA + RACAGG (SEQ ID NO: 17667) |
| 92 | TYCCA + GC + A + ARACAGG (SEQ ID NO: 17668) |
| 92 | TY + CCAGC + A + ARACAGG (SEQ ID NO: 17669) |
| 92 | T + YCCAGC + A + ARACAGG (SEQ ID NO: 17670) |
| 92 | TYC + CAGC + A + ARACAGG (SEQ ID NO: 17671) |
| 92 | TYCCAGC + A + ARACAG + G (SEQ ID NO: 17672) |
| 92 | TYCCAGC + A + ARACA + GG (SEQ ID NO: 17673) |
| 92 | TYCCAGC + A + ARA + CAGG (SEQ ID NO: 17674) |
| 92 | TYCCAGC + A + A + RACAGG (SEQ ID NO: 17675) |
| 92 | YCCAGCA + G + RACAG (SEQ ID NO: 17676) |
| 92 | YCCA + GCAGRACAG (SEQ ID NO: 17677) |
| 92 | YCCAGCA + GRACAG (SEQ ID NO: 17678) |
| 92 | YCCAG + CAGRACAG (SEQ ID NO: 17679) |
| 92 | YCCAGC + AGRACAG (SEQ ID NO: 17680) |
| 92 | YCCAGCAG + RACAG (SEQ ID NO: 17681) |
| 92 | YCCAGCAGRACA + G (SEQ ID NO: 17682) |
| 92 | YCCAGCAGRACAGG (SEQ ID NO: 17683) |
| 92 | YCCAGCAGRA + CAG (SEQ ID NO: 17684) |
| 92 | YCCA + GCA + G + RACAG (SEQ ID NO: 17685) |
| 92 | YCC + AGCA + G + RACAG (SEQ ID NO: 17686) |
| 92 | YC + CAGCA + G + RACAG (SEQ ID NO: 17687) |
| 92 | Y + CCAGCA + G + RACAG (SEQ ID NO: 17688) |
| 92 | YCCAGCA + G + RAC + AG (SEQ ID NO: 17689) |
| 92 | YCCAGCA + G + RACAGG (SEQ ID NO: 17690) |
| 92 | YCCAGCA + G + RA + CAG (SEQ ID NO: 17691) |
| 92 | YCCAGCA + G + R + ACAG (SEQ ID NO: 17692) |
| 92 | TYCCAGC + A + ARACA (SEQ ID NO: 17693) |
| 92 | TYCCA + GCAARACA (SEQ ID NO: 17694) |
| 92 | T + YCCAGCAARACA (SEQ ID NO: 17695) |
| 92 | TYCCAG + CAARACA (SEQ ID NO: 17696) |
| 92 | TY + CCAGCAARACA (SEQ ID NO: 17697) |
| 92 | TYCCAGCA + ARACA (SEQ ID NO: 17698) |
| 92 | TYCCAGCAARA + CA (SEQ ID NO: 17699) |
| 92 | TYCCAGCAARACAG (SEQ ID NO: 17700) |
| 92 | TYCCAGCAA + RACA (SEQ ID NO: 17701) |
| 92 | TYCCA + GC + A + ARACA (SEQ ID NO: 17702) |
| 92 | TY + CCAGC + A + ARACA (SEQ ID NO: 17703) |
| 92 | T + YCCAGC + A + ARACA (SEQ ID NO: 17704) |
| 92 | TYC + CAGC + A + ARACA (SEQ ID NO: 17705) |
| 92 | TYCCAGC + A + ARACAG (SEQ ID NO: 17706) |
| 92 | TYCCAGC + A + ARACA (SEQ ID NO: 17707) |
| 92 | TYCCAGC + A + ARA + CA (SEQ ID NO: 17708) |
| 92 | TYCCAGC + A + A + RACA (SEQ ID NO: 17709) |
| 92 | TYCCAGCAGRACAGGRCA (SEQ ID NO: 17710) |
| 92 | ATYCCAGCAARACAGGRC (SEQ ID NO: 17711) |
| 92 | YCCAGCAGRACAGGRCA (SEQ ID NO: 17712) |
| 92 | TYCCAGCAARACAGGRC (SEQ ID NO: 17713) |
| 92 | YCCAGCAGRACAGGR (SEQ ID NO: 17714) |
| 92 | YCCAGCAGRACAGGRC (SEQ ID NO: 17715) |
| 92 | TYCCAGCAARACAGG (SEQ ID NO: 17716) |
| 92 | YCCAGCAGRACAG (SEQ ID NO: 17717) |
| 92 | TYCCAGCAARACA (SEQ ID NO: 17718) |
| 92 | CCCAGCACARACAGG (SEQ ID NO: 17719) |
| 92 | CCCAGCAGGRACAGG (SEQ ID NO: 17720) |
| 92 | CCCAGCAGTRACAGG (SEQ ID NO: 17721) |
| 97 | GGRCARGA + R + CAGCATAYT (SEQ ID NO: 17722) |
| 97 | GG + RCARGARCAGCATAYT (SEQ ID NO: 17723) |
| 97 | GGRCARG + ARCAGCATAYT (SEQ ID NO: 17724) |
| 97 | G + GRCARGARCAGCATAYT (SEQ ID NO: 17725) |
| 97 | GGRCARGA + RCAGCATAYT (SEQ ID NO: 17726) |
| 97 | GGRCARGARCAG + CATAYT (SEQ ID NO: 17727) |
| 97 | GGRCARGARCAGCATAY + T (SEQ ID NO: 17728) |
| 97 | GGRCARGARC + AGCATAYT (SEQ ID NO: 17729) |
| 97 | GGRCARGARCA + GCATAYT (SEQ ID NO: 17730) |
| 97 | GG + RCARGA + R + CAGCATAYT (SEQ ID NO: 17731) |
| 97 | GGRC + ARGA + R + CAGCATAYT (SEQ ID NO: 17732) |
| 97 | GGR + CARGA + R + CAGCATAYT (SEQ ID NO: 17733) |
| 97 | G + GRCARGA + R + CAGCATAYT (SEQ ID NO: 17734) |
| 97 | GGRCARGA + R + CAGCATAY + T (SEQ ID NO: 17735) |
| 97 | GGRCARGA + R + CAGCA + TAYT (SEQ ID NO: 17736) |
| 97 | GGRCARGA + R + CAGC + ATAYT (SEQ ID NO: 17737) |
| 97 | GGRCARGA + R + CA + GCATAYT (SEQ ID NO: 17738) |
| 97 | GRCARGA + R + CAGCATAYT (SEQ ID NO: 17739) |
| 97 | G + RCARGARCAGCATAYT (SEQ ID NO: 17740) |
| 97 | GRCARG + ARCAGCATAYT (SEQ ID NO: 17741) |
| 97 | +GRCARGARCAGCATAYT (SEQ ID NO: 17742) |

TABLE 13-continued

| | |
|---|---|
| 97 | GRCARGA + RCAGCATAYT (SEQ ID NO: 17743) |
| 97 | GRCARGARCAG + CATAYT (SEQ ID NO: 17744) |
| 97 | GRCARGARCAGCATAY + T (SEQ ID NO: 17745) |
| 97 | GRCARGARC + AGCATAYT (SEQ ID NO: 17746) |
| 97 | GRCARGARCA + GCATAYT (SEQ ID NO: 17747) |
| 97 | G + RCARGA + R + CAGCATAYT (SEQ ID NO: 17748) |
| 97 | GRC + ARGA + R + CAGCATAYT (SEQ ID NO: 17749) |
| 97 | GR + CARGA + R + CAGCATAYT (SEQ ID NO: 17750) |
| 97 | +GRCARGA + R + CAGCATAYT (SEQ ID NO: 17751) |
| 97 | GRCARGA + R + CAGCATAY + T (SEQ ID NO: 17752) |
| 97 | GRCARGA + R + CAGCA + TAYT (SEQ ID NO: 17753) |
| 97 | GRCARGA + R + CAGC + ATAYT (SEQ ID NO: 17754) |
| 97 | GRCARGA + R + CA + GCATAYT (SEQ ID NO: 17755) |
| 97 | GRCARGA + R + CAGCATA (SEQ ID NO: 17756) |
| 97 | G + RCARGARCAGCATA (SEQ ID NO: 17757) |
| 97 | GRCARG + ARCAGCATA (SEQ ID NO: 17758) |
| 97 | +GRCARGARCAGCATA (SEQ ID NO: 17759) |
| 97 | GRCARGA + RCAGCATA (SEQ ID NO: 17760) |
| 97 | GRCARGARCAG + CATA (SEQ ID NO: 17761) |
| 97 | GRCARGARCAGCATAY (SEQ ID NO: 17762) |
| 97 | GRCARGARC + AGCATA (SEQ ID NO: 17763) |
| 97 | GRCARGARCA + GCATA (SEQ ID NO: 17764) |
| 97 | G + RCARGA + R + CAGCATA (SEQ ID NO: 17765) |
| 97 | GRC + ARGA + R + CAGCATA (SEQ ID NO: 17766) |
| 97 | GR + CARGA + R + CAGCATA (SEQ ID NO: 17767) |
| 97 | +GRCARGA + R + CAGCATA (SEQ ID NO: 17768) |
| 97 | GRCARGA + R + CAGCATAY (SEQ ID NO: 17769) |
| 97 | GRCARGA + R + CAGCA + TA (SEQ ID NO: 17770) |
| 97 | GRCARGA + R + CAGC + ATA (SEQ ID NO: 17771) |
| 97 | GRCARGA + R + CA + GCATA (SEQ ID NO: 17772) |
| 97 | GRCARGA + R + CAGCA (SEQ ID NO: 17773) |
| 97 | G + RCARGARCAGCA (SEQ ID NO: 17774) |
| 97 | GRCARG + ARCAGCA (SEQ ID NO: 17775) |
| 97 | +GRCARGARCAGCA (SEQ ID NO: 17776) |
| 97 | GRCARGA + RCAGCA (SEQ ID NO: 17777) |
| 97 | GRCARGARCAG + CA (SEQ ID NO: 17778) |
| 97 | GRCARGARCAGCAT (SEQ ID NO: 17779) |
| 97 | GRCARGARC + AGCA (SEQ ID NO: 17780) |
| 97 | GRCARGARCA + GCA (SEQ ID NO: 17781) |
| 97 | G + RCARGA + R + CAGCA (SEQ ID NO: 17782) |
| 97 | GRC + ARGA + R + CAGCA (SEQ ID NO: 17783) |
| 97 | GR + CARGA + R + CAGCA (SEQ ID NO: 17784) |
| 97 | +GRCARGA + R + CAGCA (SEQ ID NO: 17785) |
| 97 | GRCARGA + R + CAGCAT (SEQ ID NO: 17786) |
| 97 | GRCARGA + R + CAGCA (SEQ ID NO: 17787) |
| 97 | GRCARGA + R + CAGC + A (SEQ ID NO: 17788) |
| 97 | GRCARGA + R + CA + GCA (SEQ ID NO: 17789) |
| 97 | GGRCARGARCAGCATAYT (SEQ ID NO: 17790) |
| 97 | GRCARGARCAGCATAYT (SEQ ID NO: 17791) |
| 97 | GRCARGARCAGCATA (SEQ ID NO: 17792) |
| 97 | GRCARGARCAGCA (SEQ ID NO: 17793) |
| 97 | ACAGGAAGCWGCATA (SEQ ID NO: 17794) |
| 118 | ACAGAYAA + T + GYMSYAAYT (SEQ ID NO: 17795) |
| 118 | A + CAGAYAATGYMSYAAYT (SEQ ID NO: 17796) |
| 118 | ACAGAY + AATGYMSYAAYT (SEQ ID NO: 17797) |
| 118 | ACA + GAYAATGYMSYAAYT (SEQ ID NO: 17798) |
| 118 | ACAG + AYAATGYMSYAAYT (SEQ ID NO: 17799) |
| 118 | ACAGAYAATGYMSY + AAYT (SEQ ID NO: 17800) |
| 118 | ACAGAYAATGYMSYA + AYT (SEQ ID NO: 17801) |
| 118 | ACAGAYAAT + GYMSYAAYT (SEQ ID NO: 17802) |
| 118 | ACAGAYAATG + YMSYAAYT (SEQ ID NO: 17803) |
| 118 | A + CAGAYAA + T + GYMSYAAYT (SEQ ID NO: 17804) |
| 118 | ACAGAYA + A + T + GYMSYAAYT (SEQ ID NO: 17805) |
| 118 | AC + AGAYAA + T + GYMSYAAYT (SEQ ID NO: 17806) |
| 118 | ACAGAY + AA + T + GYMSYAAYT (SEQ ID NO: 17807) |
| 118 | ACAGAYAA + T + G + YMSYAAYT (SEQ ID NO: 17808) |
| 118 | ACAGAYAA + T + GYMS + YAAYT (SEQ ID NO: 17809) |
| 118 | ACAGAYAA + T + GYMSYAA + YT (SEQ ID NO: 17810) |
| 118 | ACAGAYAA + T + GYM + SYAAYT (SEQ ID NO: 17811) |
| 118 | CAGAYAA + T + GYMSYAAYT (SEQ ID NO: 17812) |
| 118 | +CAGAYAATGYMSYAAYT (SEQ ID NO: 17813) |
| 118 | CAGAY + AATGYMSYAAYT (SEQ ID NO: 17814) |

TABLE 13-continued

| | |
|---|---|
| 118 | CA + GAYAATGYMSYAAYT (SEQ ID NO: 17815) |
| 118 | CAG + AYAATGYMSYAAYT (SEQ ID NO: 17816) |
| 118 | CAGAYAATGYMSY + AAYT (SEQ ID NO: 17817) |
| 118 | CAGAYAATGYMSYA + AYT (SEQ ID NO: 17818) |
| 118 | CAGAYAAT + GYMSYAAYT (SEQ ID NO: 17819) |
| 118 | CAGAYAATG + YMSYAAYT (SEQ ID NO: 17820) |
| 118 | +CAGAYAA + T + GYMSYAAYT (SEQ ID NO: 17821) |
| 118 | CAGAYA + A + T + GYMSYAAYT (SEQ ID NO: 17822) |
| 118 | C + AGAYAA + T + GYMSYAAYT (SEQ ID NO: 17823) |
| 118 | CAGAY + AA + T + GYMSYAAYT (SEQ ID NO: 17824) |
| 118 | CAGAYAA + T + G + YMSYAAYT (SEQ ID NO: 17825) |
| 118 | CAGAYAA + T + GYMS + YAAYT (SEQ ID NO: 17826) |
| 118 | CAGAYAA + T + GYMSYAA + YT (SEQ ID NO: 17827) |
| 118 | CAGAYAA + T + GYM + SYAAYT (SEQ ID NO: 17828) |
| 118 | CAGAYAA + T + GYMSYAA (SEQ ID NO: 17829) |
| 118 | +CAGAYAATGYMSYAA (SEQ ID NO: 17830) |
| 118 | CAGAY + AATGYMSYAA (SEQ ID NO: 17831) |
| 118 | CA + GAYAATGYMSYAA (SEQ ID NO: 17832) |
| 118 | CAG + AYAATGYMSYAA (SEQ ID NO: 17833) |
| 118 | CAGAYAATGYMSY + AA (SEQ ID NO: 17834) |
| 118 | CAGAYAATGYMSYA + A (SEQ ID NO: 17835) |
| 118 | CAGAYAAT + GYMSYAA (SEQ ID NO: 17836) |
| 118 | CAGAYAATG + YMSYAA (SEQ ID NO: 17837) |
| 118 | +CAGAYAA + T + GYMSYAA (SEQ ID NO: 17838) |
| 118 | CAGAYA + A + T + GYMSYAA (SEQ ID NO: 17839) |
| 118 | C + AGAYAA + T + GYMSYAA (SEQ ID NO: 17840) |
| 118 | CAGAY + AA + T + GYMSYAA (SEQ ID NO: 17841) |
| 118 | CAGAYAA + T + G + YMSYAA (SEQ ID NO: 17842) |
| 118 | CAGAYAA + T + GYMS + YAA (SEQ ID NO: 17843) |
| 118 | CAGAYAA + T + GYMSYAA (SEQ ID NO: 17844) |
| 118 | CAGAYAA + T + GYM + SYAA (SEQ ID NO: 17845) |
| 118 | CAGAYAA + T + GYMSY (SEQ ID NO: 17846) |
| 118 | +CAGAYAATGYMSY (SEQ ID NO: 17847) |
| 118 | CAGAY + AATGYMSY (SEQ ID NO: 17848) |
| 118 | CA + GAYAATGYMSY (SEQ ID NO: 17849) |
| 118 | CAG + AYAATGYMSY (SEQ ID NO: 17850) |
| 118 | CAGAYAATGYMSY (SEQ ID NO: 17851) |
| 118 | CAGAYAATGYMSYA (SEQ ID NO: 17852) |
| 118 | CAGAYAAT + GYMSY (SEQ ID NO: 17853) |
| 118 | CAGAYAATG + YMSY (SEQ ID NO: 17854) |
| 118 | +CAGAYAA + T + GYMSY (SEQ ID NO: 17855) |
| 118 | CAGAYA + A + T + GYMSY (SEQ ID NO: 17856) |
| 118 | C + AGAYAA + T + GYMSY (SEQ ID NO: 17857) |
| 118 | CAGAY + AA + T + GYMSY (SEQ ID NO: 17858) |
| 118 | CAGAYAA + T + G + YMSY (SEQ ID NO: 17859) |
| 118 | CAGAYAA + T + GYMS + Y (SEQ ID NO: 17860) |
| 118 | CAGAYAA + T + GYMSYA (SEQ ID NO: 17861) |
| 118 | CAGAYAA + T + GYM + SY (SEQ ID NO: 17862) |
| 118 | ACAGAYAATGYMSYAAYT (SEQ ID NO: 17863) |
| 118 | CAGAYAATGYMSYAAYT (SEQ ID NO: 17864) |
| 118 | CAGAYAATGYMSYAA (SEQ ID NO: 17865) |
| 118 | CAGAYAATGYMSY (SEQ ID NO: 17866) |
| 118 | AGACAATCGNAGCAA (SEQ ID NO: 17867) |
| 118 | AGACAATAGRAGCAA (SEQ ID NO: 17868) |
| 121 | GYMSYAAY + T + YACYAGYRV (SEQ ID NO: 17869) |
| 121 | GYMSYAA + YTYACYAGYRV (SEQ ID NO: 17870) |
| 121 | G + YMSYAAYTYACYAGYRV (SEQ ID NO: 17871) |
| 121 | GY + MSYAAYTYACYAGYRV (SEQ ID NO: 17872) |
| 121 | GYMS + YAAYTYACYAGYRV (SEQ ID NO: 17873) |
| 121 | GYMSYAAYTYACY + AGYRV (SEQ ID NO: 17874) |
| 121 | GYMSYAAYTYA + CYAGYRV (SEQ ID NO: 17875) |
| 121 | GYMSYAAYTY + ACYAGYRV (SEQ ID NO: 17876) |
| 121 | GYMSYAAYTYACYAGYR + V (SEQ ID NO: 17877) |
| 121 | GYMSYAA + Y + T + YACYAGYRV (SEQ ID NO: 17878) |
| 121 | GYMS + YAAY + T + YACYAGYRV (SEQ ID NO: 17879) |
| 121 | G + YMSYAAY + T + YACYAGYRV (SEQ ID NO: 17880) |
| 121 | GYMSYA + AY + T + YACYAGYRV (SEQ ID NO: 17881) |
| 121 | GYMSYAAY + T + YACY + AGYRV (SEQ ID NO: 17882) |
| 121 | GYMSYAAY + T + YACYAGYR + V (SEQ ID NO: 17883) |
| 121 | GYMSYAAY + T + YAC + YAGYRV (SEQ ID NO: 17884) |
| 121 | GYMSYAAY + T + YA + CYAGYRV (SEQ ID NO: 17885) |
| 121 | YMSYAAY + T + YACYAGYRV (SEQ ID NO: 17886) |
| 121 | YMSYAA + YTYACYAGYRV (SEQ ID NO: 17887) |

TABLE 13-continued

| | |
|---|---|
| 121 | +YMSYAAYTYACYAGYRV (SEQ ID NO: 17888) |
| 121 | Y + MSYAAYTYACYAGYRV (SEQ ID NO: 17889) |
| 121 | YMS + YAAYTYACYAGYRV (SEQ ID NO: 17890) |
| 121 | YMSYAAYTYACY + AGYRV (SEQ ID NO: 17891) |
| 121 | YMSYAAYTYA + CYAGYRV (SEQ ID NO: 17892) |
| 121 | YMSYAAYTY + ACYAGYRV (SEQ ID NO: 17893) |
| 121 | YMSYAAYTYACYAGYR + V (SEQ ID NO: 17894) |
| 121 | YMSYAA + Y + T + YACYAGYRV (SEQ ID NO: 17895) |
| 121 | YMS + YAAY + T + YACYAGYRV (SEQ ID NO: 17896) |
| 121 | +YMSYAAY + T + YACYAGYRV (SEQ ID NO: 17897) |
| 121 | YMSYA + AY + T + YACYAGYRV (SEQ ID NO: 17898) |
| 121 | YMSYAAY + T + YACY + AGYRV (SEQ ID NO: 17899) |
| 121 | YMSYAAY + T + YACYAGYR + V (SEQ ID NO: 17900) |
| 121 | YMSYAAY + T + YAC + YAGYRV (SEQ ID NO: 17901) |
| 121 | YMSYAAY + T + YA + CYAGYRV (SEQ ID NO: 17902) |
| 121 | YMSYAAY + T + YACYAGY (SEQ ID NO: 17903) |
| 121 | YMSYAA + YTYACYAGY (SEQ ID NO: 17904) |
| 121 | +YMSYAAYTYACYAGY (SEQ ID NO: 17905) |
| 121 | Y + MSYAAYTYACYAGY (SEQ ID NO: 17906) |
| 121 | YMS + YAAYTYACYAGY (SEQ ID NO: 17907) |
| 121 | YMSYAAYTYACY + AGY (SEQ ID NO: 17908) |
| 121 | YMSYAAYTYA + CYAGY (SEQ ID NO: 17909) |
| 121 | YMSYAAYTY + ACYAGY (SEQ ID NO: 17910) |
| 121 | YMSYAAYTYACYAGYR (SEQ ID NO: 17911) |
| 121 | YMSYAA + Y + T + YACYAGY (SEQ ID NO: 17912) |
| 121 | YMS + YAAY + T + YACYAGY (SEQ ID NO: 17913) |
| 121 | +YMSYAAY + T + YACYAGY (SEQ ID NO: 17914) |
| 121 | YMSYA + AY + T + YACYAGY (SEQ ID NO: 17915) |
| 121 | YMSYAAY + T + YACY + AGY (SEQ ID NO: 17916) |
| 121 | YMSYAAY + T + YACYAGYR (SEQ ID NO: 17917) |
| 121 | YMSYAAY + T + YAC + YAGY (SEQ ID NO: 17918) |
| 121 | YMSYAAY + T + YA + CYAGY (SEQ ID NO: 17919) |
| 121 | YMSYAAY + T + YACYA (SEQ ID NO: 17920) |
| 121 | YMSYAA + YTYACYA (SEQ ID NO: 17921) |
| 121 | +YMSYAAYTYACYA (SEQ ID NO: 17922) |
| 121 | Y + MSYAAYTYACYA (SEQ ID NO: 17923) |
| 121 | YMS + YAAYTYACYA (SEQ ID NO: 17924) |
| 121 | YMSYAAYTYACY + A (SEQ ID NO: 17925) |
| 121 | YMSYAAYTYA + CYA (SEQ ID NO: 17926) |
| 121 | YMSYAAYTY + ACYA (SEQ ID NO: 17927) |
| 121 | YMSYAAYTYACYAG (SEQ ID NO: 17928) |
| 121 | YMSYAA + Y + T + YACYA (SEQ ID NO: 17929) |
| 121 | YMS + YAAY + T + YACYA (SEQ ID NO: 17930) |
| 121 | +YMSYAAY + T + YACYA (SEQ ID NO: 17931) |
| 121 | YMSYA + AY + T + YACYA (SEQ ID NO: 17932) |
| 121 | YMSYAAY + T + YACY + A (SEQ ID NO: 17933) |
| 121 | YMSYAAY + T + YACYAG (SEQ ID NO: 17934) |
| 121 | YMSYAAY + T + YAC + YA (SEQ ID NO: 17935) |
| 121 | YMSYAAY + T + YA + CYA (SEQ ID NO: 17936) |
| 121 | GYMSYAAYTYACYAGYRV (SEQ ID NO: 17937) |
| 121 | YMSYAAYTYACYAGYRV (SEQ ID NO: 17938) |
| 121 | YMSYAAYTYACYAGY (SEQ ID NO: 17939) |
| 121 | YMSYAAYTYACYA (SEQ ID NO: 17940) |
| 121 | AGCAATTAYACCAGT (SEQ ID NO: 17941) |
| 138 | TCMMRCAR + G + ATTTGGVAT (SEQ ID NO: 17942) |
| 138 | TCMMRCA + RGATTTGGVAT (SEQ ID NO: 17943) |
| 138 | TCM + MRCARGATTTGGVAT (SEQ ID NO: 17944) |
| 138 | TC + MMRCARGATTTGGVAT (SEQ ID NO: 17945) |
| 138 | TCMMRCAR + GATTTGGVAT (SEQ ID NO: 17946) |
| 138 | TCMMRCARGAT + TTGGVAT (SEQ ID NO: 17947) |
| 138 | TCMMRCARGATTTGGVA + T (SEQ ID NO: 17948) |
| 138 | TCMMRCARG + ATTTGGVAT (SEQ ID NO: 17949) |
| 138 | TCMMRCARGATTTGGV + AT (SEQ ID NO: 17950) |
| 138 | TC + MMRCAR + G + ATTTGGVAT (SEQ ID NO: 17951) |
| 138 | TCMMRC + AR + G + ATTTGGVAT (SEQ ID NO: 17952) |
| 138 | TCM + MRCAR + G + ATTTGGVAT (SEQ ID NO: 17953) |
| 138 | TCMM + RCAR + G + ATTTGGVAT (SEQ ID NO: 17954) |
| 138 | TCMMRCAR + G + ATTTGGVA + T (SEQ ID NO: 17955) |
| 138 | TCMMRCAR + G + ATT + TGGVAT (SEQ ID NO: 17956) |
| 138 | TCMMRCAR + G + ATTT + GGVAT (SEQ ID NO: 17957) |
| 138 | TCMMRCAR + G + A + TTTGGVAT (SEQ ID NO: 17958) |
| 138 | RTCMMRCA + R + AATTTGGVA (SEQ ID NO: 17959) |

TABLE 13-continued

| | |
|---|---|
| 138 | RTC + MMRCARAATTTGGVA (SEQ ID NO: 17960) |
| 138 | R + TCMMRCARAATTTGGVA (SEQ ID NO: 17961) |
| 138 | RTCM + MRCARAATTTGGVA (SEQ ID NO: 17962) |
| 138 | RTCMMRC + ARAATTTGGVA (SEQ ID NO: 17963) |
| 138 | RTCMMRCARAATTTGGV + A (SEQ ID NO: 17964) |
| 138 | RTCMMRCAR + AATTTGGVA (SEQ ID NO: 17965) |
| 138 | RTCMMRCARAAT + TTGGVA (SEQ ID NO: 17966) |
| 138 | RTCMMRCARA + ATTTGGVA (SEQ ID NO: 17967) |
| 138 | RTCMMRC + A + R + AATTTGGVA (SEQ ID NO: 17968) |
| 138 | RTCMM + RCA + R + AATTTGGVA (SEQ ID NO: 17969) |
| 138 | RT + CMMRCA + R + AATTTGGVA (SEQ ID NO: 17970) |
| 138 | RTC + MMRCA + R + AATTTGGVA (SEQ ID NO: 17971) |
| 138 | RTCMMRCA + R + AAT + TTGGVA (SEQ ID NO: 17972) |
| 138 | RTCMMRCA + R + A + ATTTGGVA (SEQ ID NO: 17973) |
| 138 | RTCMMRCA + R + AATTTGG + VA (SEQ ID NO: 17974) |
| 138 | RTCMMRCA + R + AA + TTTGGVA (SEQ ID NO: 17975) |
| 138 | CMMRCAR + G + ATTTGGVAT (SEQ ID NO: 17976) |
| 138 | CMMRCA + RGATTTGGVAT (SEQ ID NO: 17977) |
| 138 | CM + MRCARGATTTGGVAT (SEQ ID NO: 17978) |
| 138 | C + MMRCARGATTTGGVAT (SEQ ID NO: 17979) |
| 138 | CMMRCAR + GATTTGGVAT (SEQ ID NO: 17980) |
| 138 | CMMRCARGAT + TTGGVAT (SEQ ID NO: 17981) |
| 138 | CMMRCARGATTTGGVA + T (SEQ ID NO: 17982) |
| 138 | CMMRCARG + ATTTGGVAT (SEQ ID NO: 17983) |
| 138 | CMMRCARGATTTGGV + AT (SEQ ID NO: 17984) |
| 138 | C + MMRCAR + G + ATTTGGVAT (SEQ ID NO: 17985) |
| 138 | CMMRC + AR + G + ATTTGGVAT (SEQ ID NO: 17986) |
| 138 | CM + MRCAR + G + ATTTGGVAT (SEQ ID NO: 17987) |
| 138 | CMM + RCAR + G + ATTTGGVAT (SEQ ID NO: 17988) |
| 138 | CMMRCAR + G + ATTTGGVA + T (SEQ ID NO: 17989) |
| 138 | CMMRCAR + G + ATT + TGGVAT (SEQ ID NO: 17990) |
| 138 | CMMRCAR + G + ATTT + GGVAT (SEQ ID NO: 17991) |

TABLE 13-continued

| | |
|---|---|
| 138 | CMMRCAR + G + A + TTTGGVAT (SEQ ID NO: 17992) |
| 138 | TCMMRCA + R + AATTTGGVA (SEQ ID NO: 17993) |
| 138 | TC + MMRCARAATTTGGVA (SEQ ID NO: 17994) |
| 138 | +TCMMRCARAATTTGGVA (SEQ ID NO: 17995) |
| 138 | TCM + MRCARAATTTGGVA (SEQ ID NO: 17996) |
| 138 | TCMMRC + ARAATTTGGVA (SEQ ID NO: 17997) |
| 138 | TCMMRCARAATTTGGV + A (SEQ ID NO: 17998) |
| 138 | TCMMRCAR + AATTTGGVA (SEQ ID NO: 17999) |
| 138 | TCMMRCARAAT + TTGGVA (SEQ ID NO: 18000) |
| 138 | TCMMRCARA + ATTTGGVA (SEQ ID NO: 18001) |
| 138 | TCMMRC + A + R + AATTTGGVA (SEQ ID NO: 18002) |
| 138 | TCMM + RCA + R + AATTTGGVA (SEQ ID NO: 18003) |
| 138 | T + CMMRCA + R + AATTTGGVA (SEQ ID NO: 18004) |
| 138 | TC + MMRCA + R + AATTTGGVA (SEQ ID NO: 18005) |
| 138 | TCMMRCA + R + AAT + TTGGVA (SEQ ID NO: 18006) |
| 138 | TCMMRCA + R + A + ATTTGGVA (SEQ ID NO: 18007) |
| 138 | TCMMRCA + R + AATTTGG + VA (SEQ ID NO: 18008) |
| 138 | TCMMRCA + R + AA + TTTGGVA (SEQ ID NO: 18009) |
| 138 | CMMRCAR + G + ATTTGGV (SEQ ID NO: 18010) |
| 138 | CMMRCA + RGATTTGGV (SEQ ID NO: 18011) |
| 138 | CM + MRCARGATTTGGV (SEQ ID NO: 18012) |
| 138 | C + MMRCARGATTTGGV (SEQ ID NO: 18013) |
| 138 | CMMRCAR + GATTTGGV (SEQ ID NO: 18014) |
| 138 | CMMRCARGAT + TTGGV (SEQ ID NO: 18015) |
| 138 | CMMRCARGATTTGGVA (SEQ ID NO: 18016) |
| 138 | CMMRCARG + ATTTGGV (SEQ ID NO: 18017) |
| 138 | CMMRCARGATTTGGV (SEQ ID NO: 18018) |
| 138 | C + MMRCAR + G + ATTTGGV (SEQ ID NO: 18019) |
| 138 | CMMRC + AR + G + ATTTGGV (SEQ ID NO: 18020) |
| 138 | CM + MRCAR + G + ATTTGGV (SEQ ID NO: 18021) |
| 138 | CMM + RCAR + G + ATTTGGV (SEQ ID NO: 18022) |
| 138 | CMMRCAR + G + ATTTGGVA (SEQ ID NO: 18023) |
| 138 | CMMRCAR + G + ATT + TGGV (SEQ ID NO: 18024) |
| 138 | CMMRCAR + G + ATTT + GGV (SEQ ID NO: 18025) |
| 138 | CMMRCAR + G + A + TTTGGV (SEQ ID NO: 18026) |

TABLE 13-continued

| | | |
|---|---|---|
| 138 | TCMMRCA + R + AATTTGG (SEQ ID NO: 18027) |
| 138 | TC + MMRCARAATTTGG (SEQ ID NO: 18028) |
| 138 | +TCMMRCARAATTTGG (SEQ ID NO: 18029) |
| 138 | TCM + MRCARAATTTGG (SEQ ID NO: 18030) |
| 138 | TCMMRC + ARAATTTGG (SEQ ID NO: 18031) |
| 138 | TCMMRCARAATTTGGV (SEQ ID NO: 18032) |
| 138 | TCMMRCAR + AATTTGG (SEQ ID NO: 18033) |
| 138 | TCMMRCARAAT + TTGG (SEQ ID NO: 18034) |
| 138 | TCMMRCARA + ATTTGG (SEQ ID NO: 18035) |
| 138 | TCMMRC + A + R + AATTTGG (SEQ ID NO: 18036) |
| 138 | TCMM + RCA + R + AATTTGG (SEQ ID NO: 18037) |
| 138 | T + CMMRCA + R + AATTTGG (SEQ ID NO: 18038) |
| 138 | TC + MMRCA + R + AATTTGG (SEQ ID NO: 18039) |
| 138 | TCMMRCA + R + AAT + TTGG (SEQ ID NO: 18040) |
| 138 | TCMMRCA + R + A + ATTTGG (SEQ ID NO: 18041) |
| 138 | TCMMRCA + R + AATTTGG (SEQ ID NO: 18042) |
| 138 | TCMMRCA + R + AA + TTTGG (SEQ ID NO: 18043) |
| 138 | CMMRCAR + G + ATTTG (SEQ ID NO: 18044) |
| 138 | CMMRCA + RGATTTG (SEQ ID NO: 18045) |
| 138 | CM + MRCARGATTTG (SEQ ID NO: 18046) |
| 138 | C + MMRCARGATTTG (SEQ ID NO: 18047) |
| 138 | CMMRCAR + GATTTG (SEQ ID NO: 18048) |
| 138 | CMMRCARGAT + TTG (SEQ ID NO: 18049) |
| 138 | CMMRCARGATTTGG (SEQ ID NO: 18050) |
| 138 | CMMRCARG + ATTTG (SEQ ID NO: 18051) |
| 138 | C + MMRCAR + G + ATTTG (SEQ ID NO: 18052) |
| 138 | CMMRC + AR + G + ATTTG (SEQ ID NO: 18053) |
| 138 | CM + MRCAR + G + ATTTG (SEQ ID NO: 18054) |
| 138 | CMM + RCAR + G + ATTTG (SEQ ID NO: 18055) |
| 138 | CMMRCAR + G + ATTTGG (SEQ ID NO: 18056) |
| 138 | CMMRCAR + G + ATT + TG (SEQ ID NO: 18057) |
| 138 | CMMRCAR + G + ATTT + G (SEQ ID NO: 18058) |
| 138 | CMMRCAR + G + A + TTTG (SEQ ID NO: 18059) |
| 138 | TCMMRCA + R + AATTT (SEQ ID NO: 18060) |
| 138 | TC + MMRCARAATTT (SEQ ID NO: 18061) |
| 138 | +TCMMRCARAATTT (SEQ ID NO: 18062) |
| 138 | TCM + MRCARAATTT (SEQ ID NO: 18063) |
| 138 | TCMMRC + ARAATTT (SEQ ID NO: 18064) |
| 138 | TCMMRCARAATTTG (SEQ ID NO: 18065) |
| 138 | TCMMRCAR + AATTT (SEQ ID NO: 18066) |
| 138 | TCMMRCARAAT + TT (SEQ ID NO: 18067) |
| 138 | TCMMRCARA + ATTT (SEQ ID NO: 18068) |
| 138 | TCMMRC + A + R + AATTT (SEQ ID NO: 18069) |
| 138 | TCMM + RCA + R + AATTT (SEQ ID NO: 18070) |
| 138 | T + CMMRCA + R + AATTT (SEQ ID NO: 18071) |
| 138 | TC + MMRCA + R + AATTT (SEQ ID NO: 18072) |
| 138 | TCMMRCA + R + AAT + TT (SEQ ID NO: 18073) |
| 138 | TCMMRCA + R + A + ATTT (SEQ ID NO: 18074) |
| 138 | TCMMRCA + R + AATTTG (SEQ ID NO: 18075) |
| 138 | TCMMRCA + R + AA + TTT (SEQ ID NO: 18076) |
| 138 | TCMMRCARGATTTGGVAT (SEQ ID NO: 18077) |
| 138 | RTCMMRCARAATTTGGVA (SEQ ID NO: 18078) |
| 138 | CMMRCARGATTTGGVAT (SEQ ID NO: 18079) |
| 138 | TCMMRCARAATTTGGVA (SEQ ID NO: 18080) |
| 138 | CMMRCARGATTTGGV (SEQ ID NO: 18081) |
| 138 | TCMMRCARAATTTGG (SEQ ID NO: 18082) |
| 138 | CMMRCARGATTTG (SEQ ID NO: 18083) |
| 138 | TCMMRCARAATTT (SEQ ID NO: 18084) |
| 138 | AAACAGAARTTTGGA (SEQ ID NO: 18085) |
| 138 | AAACAGGCRTTTGGA (SEQ ID NO: 18086) |
| 140 | ARGAATTT + G + VATYCCCTA (SEQ ID NO: 18087) |
| 140 | ARGAA + TTTGVATYCCCTA (SEQ ID NO: 18088) |
| 140 | ARG + AATTTGVATYCCCTA (SEQ ID NO: 18089) |
| 140 | ARGAAT + TTGVATYCCCTA (SEQ ID NO: 18090) |
| 140 | ARGAATTT + GVATYCCCTA (SEQ ID NO: 18091) |
| 140 | ARGAATTTGVATYCC + CTA (SEQ ID NO: 18092) |
| 140 | ARGAATTTGVATYC + CCTA (SEQ ID NO: 18093) |
| 140 | ARGAATTTGVATYCCCT + A (SEQ ID NO: 18094) |
| 140 | ARGAATTTGVA + TYCCCTA (SEQ ID NO: 18095) |
| 140 | ARGA + ATTT + G + VATYCCCTA (SEQ ID NO: 18096) |
| 140 | ARG + AATTT + G + VATYCCCTA (SEQ ID NO: 18097) |
| 140 | ARGAATT + T + G + VATYCCCTA (SEQ ID NO: 18098) |
| 140 | A + RGAATTT + G + VATYCCCTA (SEQ ID NO: 18099) |
| 140 | ARGAATTT + G + VATY + CCCTA (SEQ ID NO: 18100) |
| 140 | ARGAATTT + G + VATYCCCT + A (SEQ ID NO: 18101) |
| 140 | ARGAATTT + G + VATYC + CCTA (SEQ ID NO: 18102) |

TABLE 13-continued

| | | |
|---|---|---|
| 140 | ARGAATTT + G + VAT + YCCCTA (SEQ ID NO: 18103) | |
| 140 | CARGAATT + T + GVATYCCCT (SEQ ID NO: 18104) | |
| 140 | CARG + AATTTGVATYCCCT (SEQ ID NO: 18105) | |
| 140 | CARGAATT + TGVATYCCCT (SEQ ID NO: 18106) | |
| 140 | CA + RGAATTTGVATYCCCT (SEQ ID NO: 18107) | |
| 140 | CARGAAT + TTGVATYCCCT (SEQ ID NO: 18108) | |
| 140 | CARGAATTTGVAT + YCCCT (SEQ ID NO: 18109) | |
| 140 | CARGAATTTGVATY + CCCT (SEQ ID NO: 18110) | |
| 140 | CARGAATTTGVATYC + CCT (SEQ ID NO: 18111) | |
| 140 | CARGAATTTGV + ATYCCCT (SEQ ID NO: 18112) | |
| 140 | CAR + GAATT + T + GVATYCCCT (SEQ ID NO: 18113) | |
| 140 | CA + RGAATT + T + GVATYCCCT (SEQ ID NO: 18114) | |
| 140 | C + ARGAATT + T + GVATYCCCT (SEQ ID NO: 18115) | |
| 140 | CARGAAT + T + T + GVATYCCCT (SEQ ID NO: 18116) | |
| 140 | CARGAATT + T + GV + ATYCCCT (SEQ ID NO: 18117) | |
| 140 | CARGAATT + T + GVATY + CCCT (SEQ ID NO: 18118) | |
| 140 | CARGAATT + T + GVA + TYCCCT (SEQ ID NO: 18119) | |
| 140 | CARGAATT + T + GVATYCC + CT (SEQ ID NO: 18120) | |
| 140 | CARGAA + TTTGVATYCCCT (SEQ ID NO: 18121) | |
| 140 | CAR + GAATTTGVATYCCCT (SEQ ID NO: 18122) | |
| 140 | C + ARGAATTTGVATYCCCT (SEQ ID NO: 18123) | |
| 140 | CARGAATTTGVATYCCC + T (SEQ ID NO: 18124) | |
| 140 | CARGAATTT + GVATYCCCT (SEQ ID NO: 18125) | |
| 140 | CARG + AATT + T + GVATYCCCT (SEQ ID NO: 18126) | |
| 140 | CARGA + ATT + T + GVATYCCCT (SEQ ID NO: 18127) | |
| 140 | CARGAATT + T + G + VATYCCCT (SEQ ID NO: 18128) | |
| 140 | CARGAATT + T + GVAT + YCCCT (SEQ ID NO: 18129) | |
| 140 | RGAATTT + G + VATYCCCTA (SEQ ID NO: 18130) | |
| 140 | RGAA + TTTGVATYCCCTA (SEQ ID NO: 18131) | |
| 140 | RG + AATTTGVATYCCCTA (SEQ ID NO: 18132) | |
| 140 | RGAAT + TTGVATYCCCTA (SEQ ID NO: 18133) | |
| 140 | RGAATTT + GVATYCCCTA (SEQ ID NO: 18134) | |
| 140 | RGAATTTGVATYCC + CTA (SEQ ID NO: 18135) | |
| 140 | RGAATTTGVATYC + CCTA (SEQ ID NO: 18136) | |
| 140 | RGAATTTGVATYCCCT + A (SEQ ID NO: 18137) | |
| 140 | RGAATTTGVA + TYCCCTA (SEQ ID NO: 18138) | |
| 140 | RGA + ATTT + G + VATYCCCTA (SEQ ID NO: 18139) | |
| 140 | RG + AATTT + G + VATYCCCTA (SEQ ID NO: 18140) | |
| 140 | RGAATT + T + G + VATYCCCTA (SEQ ID NO: 18141) | |
| 140 | +RGAATTT + G + VATYCCCTA (SEQ ID NO: 18142) | |
| 140 | RGAATTT + G + VATY + CCCTA (SEQ ID NO: 18143) | |
| 140 | RGAATTT + G + VATYCCCT + A (SEQ ID NO: 18144) | |
| 140 | RGAATTT + G + VATYC + CCTA (SEQ ID NO: 18145) | |
| 140 | RGAATTT + G + VAT + YCCCTA (SEQ ID NO: 18146) | |
| 140 | ARGAATT + T + GVATYCCCT (SEQ ID NO: 18147) | |
| 140 | ARG + AATTTGVATYCCCT (SEQ ID NO: 18148) | |
| 140 | ARGAATT + TGVATYCCCT (SEQ ID NO: 18149) | |
| 140 | A + RGAATTTGVATYCCCT (SEQ ID NO: 18150) | |
| 140 | ARGAAT + TTGVATYCCCT (SEQ ID NO: 18151) | |
| 140 | ARGAATTTGVAT + YCCCT (SEQ ID NO: 18152) | |
| 140 | ARGAATTTGVATY + CCCT (SEQ ID NO: 18153) | |
| 140 | ARGAATTTGVATYC + CCT (SEQ ID NO: 18154) | |
| 140 | ARGAATTTGV + ATYCCCT (SEQ ID NO: 18155) | |
| 140 | AR + GAATT + T + GVATYCCCT (SEQ ID NO: 18156) | |
| 140 | A + RGAATT + T + GVATYCCCT (SEQ ID NO: 18157) | |
| 140 | +ARGAATT + T + GVATYCCCT (SEQ ID NO: 18158) | |
| 140 | ARGAAT + T + T + GVATYCCCT (SEQ ID NO: 18159) | |
| 140 | ARGAATT + T + GV + ATYCCCT (SEQ ID NO: 18160) | |
| 140 | ARGAATT + T + GVATY + CCCT (SEQ ID NO: 18161) | |
| 140 | ARGAATT + T + GVA + TYCCCT (SEQ ID NO: 18162) | |
| 140 | ARGAATT + T + GVATYCC + CT (SEQ ID NO: 18163) | |
| 140 | ARGAA + TTTGVATYCCCT (SEQ ID NO: 18164) | |
| 140 | AR + GAATTTGVATYCCCT (SEQ ID NO: 18165) | |
| 140 | +ARGAATTTGVATYCCCT (SEQ ID NO: 18166) | |
| 140 | ARGAATTTGVATYCCC + T (SEQ ID NO: 18167) | |
| 140 | ARGAATTT + GVATYCCCT (SEQ ID NO: 18168) | |

TABLE 13-continued

| | |
|---|---|
| 140 | ARG + AATT + T + GVATYCCCT (SEQ ID NO: 18169) |
| 140 | ARGA + ATT + T + GVATYCCCT (SEQ ID NO: 18170) |
| 140 | ARGAATT + T + G + VATYCCCT (SEQ ID NO: 18171) |
| 140 | ARGAATT + T + GVAT + YCCCT (SEQ ID NO: 18172) |
| 140 | RGAATTT + G + VATYCCC (SEQ ID NO: 18173) |
| 140 | RGAA + TTTGVATYCCC (SEQ ID NO: 18174) |
| 140 | RG + AATTTGVATYCCC (SEQ ID NO: 18175) |
| 140 | RGAAT + TTGVATYCCC (SEQ ID NO: 18176) |
| 140 | RGAATTT + GVATYCCC (SEQ ID NO: 18177) |
| 140 | RGAATTTGVATYCC + C (SEQ ID NO: 18178) |
| 140 | RGAATTTGVATYC + CC (SEQ ID NO: 18179) |
| 140 | RGAATTTGVATYCCCT (SEQ ID NO: 18180) |
| 140 | RGAATTTGVA + TYCCC (SEQ ID NO: 18181) |
| 140 | RGA + ATTT + G + VATYCCC (SEQ ID NO: 18182) |
| 140 | RG + AATTT + G + VATYCCC (SEQ ID NO: 18183) |
| 140 | RGAATT + T + G + VATYCCC (SEQ ID NO: 18184) |
| 140 | +RGAATTT + G + VATYCCC (SEQ ID NO: 18185) |
| 140 | RGAATTT + G + VATY + CCC (SEQ ID NO: 18186) |
| 140 | RGAATTT + G + VATYCCCT (SEQ ID NO: 18187) |
| 140 | RGAATTT + G + VATYC + CC (SEQ ID NO: 18188) |
| 140 | RGAATTT + G + VAT + YCCC (SEQ ID NO: 18189) |
| 140 | ARGAATT + T + GVATYCC (SEQ ID NO: 18190) |
| 140 | ARG + AATTTGVATYCC (SEQ ID NO: 18191) |
| 140 | ARGAATT + TGVATYCC (SEQ ID NO: 18192) |
| 140 | A + RGAATTTGVATYCC (SEQ ID NO: 18193) |
| 140 | ARGAAT + TTGVATYCC (SEQ ID NO: 18194) |
| 140 | ARGAATTTGVAT + YCC (SEQ ID NO: 18195) |
| 140 | ARGAATTTGVATY + CC (SEQ ID NO: 18196) |
| 140 | ARGAATTTGVATYC + C (SEQ ID NO: 18197) |
| 140 | ARGAATTTGV + ATYCC (SEQ ID NO: 18198) |
| 140 | AR + GAATT + T + GVATYCC (SEQ ID NO: 18199) |
| 140 | A + RGAATT + T + GVATYCC (SEQ ID NO: 18200) |
| 140 | +ARGAATT + T + GVATYCC (SEQ ID NO: 18201) |
| 140 | ARGAAT + T + T + GVATYCC (SEQ ID NO: 18202) |
| 140 | ARGAATT + T + GV + ATYCC (SEQ ID NO: 18203) |
| 140 | ARGAATT + T + GVATY + CC (SEQ ID NO: 18204) |
| 140 | ARGAATT + T + GVA + TYCC (SEQ ID NO: 18205) |
| 140 | ARGAATT + T + GVATYCC (SEQ ID NO: 18206) |
| 140 | ARGAA + TTTGVATYCC (SEQ ID NO: 18207) |
| 140 | AR + GAATTTGVATYCC (SEQ ID NO: 18208) |
| 140 | +ARGAATTTGVATYCC (SEQ ID NO: 18209) |
| 140 | ARGAATTTGVATYCC (SEQ ID NO: 18210) |
| 140 | ARGAATTT + GVATYCC (SEQ ID NO: 18211) |
| 140 | ARG + AATT + T + GVATYCC (SEQ ID NO: 18212) |
| 140 | ARGA + ATT + T + GVATYCC (SEQ ID NO: 18213) |
| 140 | ARGAATT + T + G + VATYCC (SEQ ID NO: 18214) |
| 140 | ARGAATT + T + GVAT + YCC (SEQ ID NO: 18215) |
| 140 | RGAATTT + G + VATYC (SEQ ID NO: 18216) |
| 140 | RGAA + TTTGVATYC (SEQ ID NO: 18217) |
| 140 | RG + AATTTGVATYC (SEQ ID NO: 18218) |
| 140 | RGAAT + TTGVATYC (SEQ ID NO: 18219) |
| 140 | RGAATTT + GVATYC (SEQ ID NO: 18220) |
| 140 | RGAATTTGVATYCC (SEQ ID NO: 18221) |
| 140 | RGAATTTGVATYC (SEQ ID NO: 18222) |
| 140 | RGAATTTGVA + TYC (SEQ ID NO: 18223) |
| 140 | RGA + ATTT + G + VATYC (SEQ ID NO: 18224) |
| 140 | RG + AATTT + G + VATYC (SEQ ID NO: 18225) |
| 140 | RGAATT + T + G + VATYC (SEQ ID NO: 18226) |
| 140 | +RGAATTT + G + VATYC (SEQ ID NO: 18227) |
| 140 | RGAATTT + G + VATY + C (SEQ ID NO: 18228) |
| 140 | RGAATTT + G + VATYCC (SEQ ID NO: 18229) |
| 140 | RGAATTT + G + VATYC (SEQ ID NO: 18230) |
| 140 | RGAATTT + G + VAT + YC (SEQ ID NO: 18231) |
| 140 | ARGAATT + T + GVATY (SEQ ID NO: 18232) |
| 140 | ARG + AATTTGVATY (SEQ ID NO: 18233) |
| 140 | ARGAATT + TGVATY (SEQ ID NO: 18234) |
| 140 | A + RGAATTTGVATY (SEQ ID NO: 18235) |
| 140 | ARGAAT + TTGVATY (SEQ ID NO: 18236) |
| 140 | ARGAATTTGVAT + Y (SEQ ID NO: 18237) |
| 140 | ARGAATTTGVATY (SEQ ID NO: 18238) |
| 140 | ARGAATTTGVATYC (SEQ ID NO: 18239) |
| 140 | ARGAATTTGV + ATY (SEQ ID NO: 18240) |
| 140 | AR + GAATT + T + GVATY (SEQ ID NO: 18241) |
| 140 | A + RGAATT + T + GVATY (SEQ ID NO: 18242) |
| 140 | +ARGAATT + T + GVATY (SEQ ID NO: 18243) |
| 140 | ARGAAT + T + T + GVATY (SEQ ID NO: 18244) |
| 140 | ARGAATT + T + GV + ATY (SEQ ID NO: 18245) |
| 140 | ARGAATT + T + GVATY (SEQ ID NO: 18246) |

TABLE 13-continued

| | |
|---|---|
| 140 | ARGAATT + T + GVA + TY (SEQ ID NO: 18247) |
| 140 | ARGAATT + T + GVATYC (SEQ ID NO: 18248) |
| 140 | ARGAA + TTTGVATY (SEQ ID NO: 18249) |
| 140 | AR + GAATTTGVATY (SEQ ID NO: 18250) |
| 140 | +ARGAATTTGVATY (SEQ ID NO: 18251) |
| 140 | ARGAATTT + GVATY (SEQ ID NO: 18252) |
| 140 | ARG + AATT + T + GVATY (SEQ ID NO: 18253) |
| 140 | ARGA + ATT + T + GVATY (SEQ ID NO: 18254) |
| 140 | ARGAATT + T + G + VATY (SEQ ID NO: 18255) |
| 140 | ARGAATT + T + GVAT + Y (SEQ ID NO: 18256) |
| 140 | ARGAATTTGVATYCCCTA (SEQ ID NO: 18257) |
| 140 | CARGAATTTGVATYCCCT (SEQ ID NO: 18258) |
| 140 | RGAATTTGVATYCCCTA (SEQ ID NO: 18259) |
| 140 | ARGAATTTGVATYCCCT (SEQ ID NO: 18260) |
| 140 | RGAATTTGVATYCCC (SEQ ID NO: 18261) |
| 140 | ARGAATTTGVATYCC (SEQ ID NO: 18262) |
| 140 | RGAATTTGVATYC (SEQ ID NO: 18263) |
| 140 | ARGAATTTGVATY (SEQ ID NO: 18264) |
| 140 | AATTTAGYATTCCCT (SEQ ID NO: 18265) |
| 140 | AATTTGCNATTCCCT (SEQ ID NO: 18266) |
| 140 | AATTTTGYATTCCCT (SEQ ID NO: 18267) |
| 143 | GVATYCCC + T + CAATCCCA (SEQ ID NO: 18268) |
| 143 | GVAT + YCCCTCAATCCCA (SEQ ID NO: 18269) |
| 143 | GV + ATYCCCTCAATCCCA (SEQ ID NO: 18270) |
| 143 | GVATY + CCCTCAATCCCA (SEQ ID NO: 18271) |
| 143 | GVATYCCC + TCAATCCCA (SEQ ID NO: 18272) |
| 143 | GVATYCCCTCAATC + CCA (SEQ ID NO: 18273) |
| 143 | GVATYCCCTCAATCC + CA (SEQ ID NO: 18274) |
| 143 | GVATYCCCTC + AATCCCA (SEQ ID NO: 18275) |
| 143 | GVATYCCCTCAAT + CCCA (SEQ ID NO: 18276) |
| 143 | GV + ATYCCC + T + CAATCCCA (SEQ ID NO: 18277) |
| 143 | GVATYC + CC + T + CAATCCCA (SEQ ID NO: 18278) |
| 143 | G + VATYCCC + T + CAATCCCA (SEQ ID NO: 18279) |
| 143 | GVATY + CCC + T + CAATCCCA (SEQ ID NO: 18280) |
| 143 | GVATYCCC + T + CAATCCC + CA (SEQ ID NO: 18281) |
| 143 | GVATYCCC + T + CAA + TCCCA (SEQ ID NO: 18282) |
| 143 | GVATYCCC + T + CAATCCCC + A (SEQ ID NO: 18283) |
| 143 | GVATYCCC + T + C + AATCCCCA (SEQ ID NO: 18284) |
| 143 | GGVATYCC + C + ACAATCCCC (SEQ ID NO: 18285) |
| 143 | G + GVATYCCCACAATCCCC (SEQ ID NO: 18286) |
| 143 | GG + VATYCCCACAATCCCC (SEQ ID NO: 18287) |
| 143 | GGVATYCC + CACAATCCCC (SEQ ID NO: 18288) |
| 143 | GGVA + TYCCCACAATCCCC (SEQ ID NO: 18289) |
| 143 | GGVATYCCCACAA + TCCCC (SEQ ID NO: 18290) |
| 143 | GGVATYCCCACAATCCC + C (SEQ ID NO: 18291) |
| 143 | GGVATYCCCA + CAATCCCC (SEQ ID NO: 18292) |
| 143 | GGVATYCCCAC + AATCCCC (SEQ ID NO: 18293) |
| 143 | GGVATY + CC + C + ACAATCCCC (SEQ ID NO: 18294) |
| 143 | GGVAT + YCC + C + ACAATCCCC (SEQ ID NO: 18295) |
| 143 | GG + VATYCC + C + ACAATCCCC (SEQ ID NO: 18296) |
| 143 | GGVA + TYCC + C + ACAATCCCC (SEQ ID NO: 18297) |
| 143 | GGVATYCC + C + ACAATC + CCC (SEQ ID NO: 18298) |
| 143 | GGVATYCC + C + A + CAATCCCC (SEQ ID NO: 18299) |
| 143 | GGVATYCC + C + ACAA + TCCCC (SEQ ID NO: 18300) |
| 143 | GGVATYCC + C + ACAATCCC + C (SEQ ID NO: 18301) |
| 143 | G + VATYCCCTCAATCCCA (SEQ ID NO: 18302) |
| 143 | GVA + TYCCCTCAATCCCA (SEQ ID NO: 18303) |
| 143 | GVATYCCCTCAATCCCC + A (SEQ ID NO: 18304) |
| 143 | GVATYCCCTCA + ATCCCCA (SEQ ID NO: 18305) |
| 143 | GVATYCC + C + T + CAATCCCCA (SEQ ID NO: 18306) |
| 143 | GVATYCCC + T + CAAT + CCCCA (SEQ ID NO: 18307) |
| 143 | GVATYCCC + T + CA + ATCCCCA (SEQ ID NO: 18308) |
| 143 | VATYCCC + T + CAATCCCCA (SEQ ID NO: 18309) |
| 143 | VAT + YCCCTCAATCCCCA (SEQ ID NO: 18310) |
| 143 | V + ATYCCCTCAATCCCCA (SEQ ID NO: 18311) |
| 143 | VATY + CCCTCAATCCCCA (SEQ ID NO: 18312) |
| 143 | VATYCCC + TCAATCCCCA (SEQ ID NO: 18313) |
| 143 | VATYCCCTCAATC + CCCA (SEQ ID NO: 18314) |
| 143 | VATYCCCTCAATCC + CCA (SEQ ID NO: 18315) |
| 143 | VATYCCCTC + AATCCCCA (SEQ ID NO: 18316) |
| 143 | VATYCCCTCAAT + CCCCA (SEQ ID NO: 18317) |

TABLE 13-continued

| 143 | V + ATYCCC + T + CAATCCCCA (SEQ ID NO: 18318) |
| --- | --- |
| 143 | VATYC + CC + T + CAATCCCCA (SEQ ID NO: 18319) |
| 143 | +VATYCCC + T + CAATCCCCA (SEQ ID NO: 18320) |
| 143 | VATY + CCC + T + CAATCCCCA (SEQ ID NO: 18321) |
| 143 | VATYCCC + T + CAATCCC + CA (SEQ ID NO: 18322) |
| 143 | VATYCCC + T + CAA + TCCCCA (SEQ ID NO: 18323) |
| 143 | VATYCCC + T + CAATCCCC + A (SEQ ID NO: 18324) |
| 143 | VATYCCC + T + C + AATCCCCA (SEQ ID NO: 18325) |
| 143 | GVATYCC + C + ACAATCCCC (SEQ ID NO: 18326) |
| 143 | +GVATYCCCACAATCCCC (SEQ ID NO: 18327) |
| 143 | G + VATYCCCACAATCCCC (SEQ ID NO: 18328) |
| 143 | GVATYCC + CACAATCCCC (SEQ ID NO: 18329) |
| 143 | GVA + TYCCCACAATCCCC (SEQ ID NO: 18330) |
| 143 | GVATYCCCACAA + TCCCC (SEQ ID NO: 18331) |
| 143 | GVATYCCCACAATCCC + C (SEQ ID NO: 18332) |
| 143 | GVATYCCCA + CAATCCCC (SEQ ID NO: 18333) |
| 143 | GVATYCCCAC + AATCCCC (SEQ ID NO: 18334) |
| 143 | GVATY + CC + C + ACAATCCCC (SEQ ID NO: 18335) |
| 143 | GVAT + YCC + C + ACAATCCCC (SEQ ID NO: 18336) |
| 143 | G + VATYCC + C + ACAATCCCC (SEQ ID NO: 18337) |
| 143 | GVA + TYCC + C + ACAATCCCC (SEQ ID NO: 18338) |
| 143 | GVATYCC + C + ACAATC + CCC (SEQ ID NO: 18339) |
| 143 | GVATYCC + C + A + CAATCCCC (SEQ ID NO: 18340) |
| 143 | GVATYCC + C + ACAA + TCCCC (SEQ ID NO: 18341) |
| 143 | GVATYCC + C + ACAATCCC + C (SEQ ID NO: 18342) |
| 143 | +VATYCCCTCAATCCCCA (SEQ ID NO: 18343) |
| 143 | VA + TYCCCTCAATCCCCA (SEQ ID NO: 18344) |
| 143 | VATYCCCTCAATCCCC + A (SEQ ID NO: 18345) |
| 143 | VATYCCCTCA + ATCCCCA (SEQ ID NO: 18346) |
| 143 | VATYCC + C + T + CAATCCCCA (SEQ ID NO: 18347) |
| 143 | VATYCCC + T + CAAT + CCCCA (SEQ ID NO: 18348) |
| 143 | VATYCCC + T + CA + ATCCCCA (SEQ ID NO: 18349) |
| 143 | VATYCCC + T + CAATCCC (SEQ ID NO: 18350) |
| 143 | VAT + YCCCTCAATCCC (SEQ ID NO: 18351) |
| 143 | V + ATYCCCTCAATCCC (SEQ ID NO: 18352) |
| 143 | VATY + CCCTCAATCCC (SEQ ID NO: 18353) |
| 143 | VATYCCC + TCAATCCC (SEQ ID NO: 18354) |
| 143 | VATYCCCTCAATC + CC (SEQ ID NO: 18355) |
| 143 | VATYCCCTCAATCC + C (SEQ ID NO: 18356) |
| 143 | VATYCCCTC + AATCCC (SEQ ID NO: 18357) |
| 143 | VATYCCCTCAAT + CCC (SEQ ID NO: 18358) |
| 143 | V + ATYCCC + T + CAATCCC (SEQ ID NO: 18359) |
| 143 | VATYC + CC + T + CAATCCC (SEQ ID NO: 18360) |
| 143 | +VATYCCC + T + CAATCCC (SEQ ID NO: 18361) |
| 143 | VATY + CCC + T + CAATCCC (SEQ ID NO: 18362) |
| 143 | VATYCCC + T + CAATCCC (SEQ ID NO: 18363) |
| 143 | VATYCCC + T + CAA + TCCC (SEQ ID NO: 18364) |
| 143 | VATYCCC + T + CAATCCCC (SEQ ID NO: 18365) |
| 143 | VATYCCC + T + C + AATCCC (SEQ ID NO: 18366) |
| 143 | GVATYCC + C + ACAATCC (SEQ ID NO: 18367) |
| 143 | +GVATYCCCACAATCC (SEQ ID NO: 18368) |
| 143 | G + VATYCCCACAATCC (SEQ ID NO: 18369) |
| 143 | GVATYCC + CACAATCC (SEQ ID NO: 18370) |
| 143 | GVA + TYCCCACAATCC (SEQ ID NO: 18371) |
| 143 | GVATYCCCACAA + TCC (SEQ ID NO: 18372) |
| 143 | GVATYCCCACAATCCC (SEQ ID NO: 18373) |
| 143 | GVATYCCCA + CAATCC (SEQ ID NO: 18374) |
| 143 | GVATYCCCAC + AATCC (SEQ ID NO: 18375) |
| 143 | GVATY + CC + C + ACAATCC (SEQ ID NO: 18376) |
| 143 | GVAT + YCC + C + ACAATCC (SEQ ID NO: 18377) |
| 143 | G + VATYCC + C + ACAATCC (SEQ ID NO: 18378) |
| 143 | GVA + TYCC + C + ACAATCC (SEQ ID NO: 18379) |
| 143 | GVATYCC + C + ACAATC + C (SEQ ID NO: 18380) |
| 143 | GVATYCC + C + A + CAATCC (SEQ ID NO: 18381) |
| 143 | GVATYCC + C + ACAA + TCC (SEQ ID NO: 18382) |
| 143 | GVATYCC + C + ACAATCCC (SEQ ID NO: 18383) |
| 143 | +VATYCCCTCAATCCC (SEQ ID NO: 18384) |
| 143 | VA + TYCCCTCAATCCC (SEQ ID NO: 18385) |
| 143 | VATYCCCTCAATCCCC (SEQ ID NO: 18386) |
| 143 | VATYCCCTCA + ATCCC (SEQ ID NO: 18387) |
| 143 | VATYCC + C + T + CAATCCC (SEQ ID NO: 18388) |

TABLE 13-continued

| | | |
|---|---|---|
| 143 | VATYCCC + T + CAAT + CCC (SEQ ID NO: 18389) | |
| 143 | VATYCCC + T + CA + ATCCC (SEQ ID NO: 18390) | |
| 143 | VATYCCC + T + CAATC (SEQ ID NO: 18391) | |
| 143 | VAT + YCCCTCAATC (SEQ ID NO: 18392) | |
| 143 | V + ATYCCCTCAATC (SEQ ID NO: 18393) | |
| 143 | VATY + CCCTCAATC (SEQ ID NO: 18394) | |
| 143 | VATYCCC + TCAATC (SEQ ID NO: 18395) | |
| 143 | VATYCCCTCAATC (SEQ ID NO: 18396) | |
| 143 | VATYCCCTCAATCC (SEQ ID NO: 18397) | |
| 143 | VATYCCCTC + AATC (SEQ ID NO: 18398) | |
| 143 | VATYCCCTCAAT + C (SEQ ID NO: 18399) | |
| 143 | V + ATYCCC + T + CAATC (SEQ ID NO: 18400) | |
| 143 | VATYC + CC + T + CAATC (SEQ ID NO: 18401) | |
| 143 | +VATYCCC + T + CAATC (SEQ ID NO: 18402) | |
| 143 | VATY + CCC + T + CAATC (SEQ ID NO: 18403) | |
| 143 | VATYCCC + T + CAATCC (SEQ ID NO: 18404) | |
| 143 | VATYCCC + T + CAA + TC (SEQ ID NO: 18405) | |
| 143 | VATYCCC + T + C + AATC (SEQ ID NO: 18406) | |
| 143 | GVATYCC + C + ACAAT (SEQ ID NO: 18407) | |
| 143 | +GVATYCCCACAAT (SEQ ID NO: 18408) | |
| 143 | G + VATYCCCACAAT (SEQ ID NO: 18409) | |
| 143 | GVATYCC + CACAAT (SEQ ID NO: 18410) | |
| 143 | GVA + TYCCCACAAT (SEQ ID NO: 18411) | |
| 143 | GVATYCCCACAA + T (SEQ ID NO: 18412) | |
| 143 | GVATYCCCACAATC (SEQ ID NO: 18413) | |
| 143 | GVATYCCCA + CAAT (SEQ ID NO: 18414) | |
| 143 | GVATYCCCAC + AAT (SEQ ID NO: 18415) | |
| 143 | GVATY + CC + C + ACAAT (SEQ ID NO: 18416) | |
| 143 | GVAT + YCC + C + ACAAT (SEQ ID NO: 18417) | |
| 143 | G + VATYCC + C + ACAAT (SEQ ID NO: 18418) | |
| 143 | GVA + TYCC + C + ACAAT (SEQ ID NO: 18419) | |
| 143 | GVATYCC + C + ACAATC (SEQ ID NO: 18420) | |
| 143 | GVATYCC + C + A + CAAT (SEQ ID NO: 18421) | |
| 143 | GVATYCC + C + ACAA + T (SEQ ID NO: 18422) | |
| 143 | +VATYCCCTCAATC (SEQ ID NO: 18423) | |
| 143 | VA + TYCCCTCAATC (SEQ ID NO: 18424) | |
| 143 | VATYCCCTCA + ATC (SEQ ID NO: 18425) | |
| 143 | VATYCC + C + T + CAATC (SEQ ID NO: 18426) | |
| 143 | VATYCCC + T + CAAT + C (SEQ ID NO: 18427) | |
| 143 | VATYCCC + T + CA + ATC (SEQ ID NO: 18428) | |
| 143 | GVATYCCCTCAATCCCCA (SEQ ID NO: 18429) | |
| 143 | GGVATYCCCACAATCCCC (SEQ ID NO: 18430) | |
| 143 | VATYCCCTCAATCCCCA (SEQ ID NO: 18431) | |
| 143 | GVATYCCCACAATCCCC (SEQ ID NO: 18432) | |
| 143 | VATYCCCTCAATCCC (SEQ ID NO: 18433) | |
| 143 | GVATYCCCACAATCC (SEQ ID NO: 18434) | |
| 143 | VATYCCCTCAATC (SEQ ID NO: 18435) | |
| 143 | GVATYCCCACAAT (SEQ ID NO: 18436) | |
| 143 | ATTCCCTGYAATCCC (SEQ ID NO: 18437) | |
| 143 | ATTCCCCGYAATCCC (SEQ ID NO: 18438) | |
| 143 | ATTCCCAGRAATCCC (SEQ ID NO: 18439) | |
| 143 | ATTCCCCAYAATCCC (SEQ ID NO: 18440) | |
| 143 | ATTCCCAARAATCCC (SEQ ID NO: 18441) | |
| 143 | ATTCCCAGYAATCCC (SEQ ID NO: 18442) | |
| 143 | ATTCCCGGYAATCCC (SEQ ID NO: 18443) | |
| 143 | ATTCCCGCYAATCCC (SEQ ID NO: 18444) | |
| 145 | CCCTACAA + T + CCCAAAGYC (SEQ ID NO: 18445) | |
| 145 | C + CCTACAATCCCAAAGYC (SEQ ID NO: 18446) | |
| 145 | CC + CTACAATCCCAAAGYC (SEQ ID NO: 18447) | |
| 145 | CCCTACAA + TCCCAAAGYC (SEQ ID NO: 18448) | |
| 145 | CCC + TACAATCCCAAAGYC (SEQ ID NO: 18449) | |
| 145 | CCCTACAATCCCAAAGY + C (SEQ ID NO: 18450) | |
| 145 | CCCTACAATCCCA + AAGYC (SEQ ID NO: 18451) | |
| 145 | CCCTACAATCCC + AAAGYC (SEQ ID NO: 18452) | |
| 145 | CCCTACAATCCCAA + AGYC (SEQ ID NO: 18453) | |
| 145 | CC + CTACAA + T + CCCAAAGYC (SEQ ID NO: 18454) | |
| 145 | CCC + TACAA + T + CCCAAAGYC (SEQ ID NO: 18455) | |
| 145 | CCCTACA + A + T + CCCAAAGYC (SEQ ID NO: 18456) | |
| 145 | CCCTA + CAA + T + CCCAAAGYC (SEQ ID NO: 18457) | |
| 145 | CCCTACAA + T + CCCAA + AGYC (SEQ ID NO: 18458) | |
| 145 | CCCTACAA + T + C + CCAAAGYC (SEQ ID NO: 18459) | |
| 145 | CCCTACAA + T + CCCA + AAGYC (SEQ ID NO: 18460) | |
| 145 | CCCTACAA + T + CCCAAAGY + C (SEQ ID NO: 18461) | |
| 145 | CCTACAA + T + CCCAAAGYC (SEQ ID NO: 18462) | |
| 145 | +CCTACAATCCCAAAGYC (SEQ ID NO: 18463) | |
| 145 | C + CTACAATCCCAAAGYC (SEQ ID NO: 18464) | |

TABLE 13-continued

| 145 | CCTACAA + TCCCAAAGYC (SEQ ID NO: 18465) |
| 145 | CC + TACAATCCCAAAGYC (SEQ ID NO: 18466) |
| 145 | CCTACAATCCCAAAGY + C (SEQ ID NO: 18467) |
| 145 | CCTACAATCCCA + AAGYC (SEQ ID NO: 18468) |
| 145 | CCTACAATCCC + AAAGYC (SEQ ID NO: 18469) |
| 145 | CCTACAATCCCAA + AGYC (SEQ ID NO: 18470) |
| 145 | C + CTACAA + T + CCCAAAGYC (SEQ ID NO: 18471) |
| 145 | CC + TACAA + T + CCCAAAGYC (SEQ ID NO: 18472) |
| 145 | CCTACA + A + T + CCCAAAGYC (SEQ ID NO: 18473) |
| 145 | CCTA + CAA + T + CCCAAAGYC (SEQ ID NO: 18474) |
| 145 | CCTACAA + T + CCCAA + AGYC (SEQ ID NO: 18475) |
| 145 | CCTACAA + T + C + CCAAAGYC (SEQ ID NO: 18476) |
| 145 | CCTACAA + T + CCCA + AAGYC (SEQ ID NO: 18477) |
| 145 | CCTACAA + T + CCCAAAGY + C (SEQ ID NO: 18478) |
| 145 | CCTACAA + T + CCCAAAG (SEQ ID NO: 18479) |
| 145 | +CCTACAATCCCAAAG (SEQ ID NO: 18480) |
| 145 | C + CTACAATCCCAAAG (SEQ ID NO: 18481) |
| 145 | CCTACAA + TCCCAAAG (SEQ ID NO: 18482) |
| 145 | CC + TACAATCCCAAAG (SEQ ID NO: 18483) |
| 145 | CCTACAATCCCAAAGY (SEQ ID NO: 18484) |
| 145 | CCTACAATCCCA + AAG (SEQ ID NO: 18485) |
| 145 | CCTACAATCCC + AAAG (SEQ ID NO: 18486) |
| 145 | CCTACAATCCCAA + AG (SEQ ID NO: 18487) |
| 145 | C + CTACAA + T + CCCAAAG (SEQ ID NO: 18488) |
| 145 | CC + TACAA + T + CCCAAAG (SEQ ID NO: 18489) |
| 145 | CCTACA + A + T + CCCAAAG (SEQ ID NO: 18490) |
| 145 | CCTA + CAA + T + CCCAAAG (SEQ ID NO: 18491) |
| 145 | CCTACAA + T + CCCAA + AG (SEQ ID NO: 18492) |
| 145 | CCTACAA + T + C + CCAAAG (SEQ ID NO: 18493) |
| 145 | CCTACAA + T + CCCA + AAG (SEQ ID NO: 18494) |
| 145 | CCTACAA + T + CCCAAAGY (SEQ ID NO: 18495) |
| 145 | CCTACAA + T + CCCAA (SEQ ID NO: 18496) |
| 145 | +CCTACAATCCCAA (SEQ ID NO: 18497) |
| 145 | C + CTACAATCCCAA (SEQ ID NO: 18498) |
| 145 | CCTACAA + TCCCAA (SEQ ID NO: 18499) |
| 145 | CC + TACAATCCCAA (SEQ ID NO: 18500) |
| 145 | CCTACAATCCCAAA (SEQ ID NO: 18501) |
| 145 | CCTACAATCCCA + A (SEQ ID NO: 18502) |
| 145 | CCTACAATCCC + AA (SEQ ID NO: 18503) |
| 145 | CCTACAATCCCAA (SEQ ID NO: 18504) |
| 145 | C + CTACAA + T + CCCAA (SEQ ID NO: 18505) |
| 145 | CC + TACAA + T + CCCAA (SEQ ID NO: 18506) |
| 145 | CCTACA + A + T + CCCAA (SEQ ID NO: 18507) |
| 145 | CCTA + CAA + T + CCCAA (SEQ ID NO: 18508) |
| 145 | CCTACAA + T + CCCAA (SEQ ID NO: 18509) |
| 145 | CCTACAA + T + C + CCAA (SEQ ID NO: 18510) |
| 145 | CCTACAA + T + CCCA + A (SEQ ID NO: 18511) |
| 145 | CCTACAA + T + CCCAAA (SEQ ID NO: 18512) |
| 145 | CCCTACAATCCCAAAGYC (SEQ ID NO: 18513) |
| 145 | CCTACAATCCCAAAGYC (SEQ ID NO: 18514) |
| 145 | CCTACAATCCCAAAG (SEQ ID NO: 18515) |
| 145 | CCTACAATCCCAA (SEQ ID NO: 18516) |
| 145 | TACAATAGYCAAAGT (SEQ ID NO: 18517) |
| 146 | ACAATCCC + C + AAGYCARGG (SEQ ID NO: 18518) |
| 146 | ACAAT + CCCCAAGYCARGG (SEQ ID NO: 18519) |
| 146 | ACAATCC + CCAAGYCARGG (SEQ ID NO: 18520) |
| 146 | ACAA + TCCCCAAGYCARGG (SEQ ID NO: 18521) |
| 146 | ACA + ATCCCCAAGYCARGG (SEQ ID NO: 18522) |
| 146 | ACAATCCCCAAGYCA + RGG (SEQ ID NO: 18523) |
| 146 | ACAATCCCC + AAGYCARGG (SEQ ID NO: 18524) |
| 146 | ACAATCCCCAAGYC + ARGG (SEQ ID NO: 18525) |
| 146 | ACAATCCCCAAGY + CARGG (SEQ ID NO: 18526) |
| 146 | ACAA + TCCC + C + AAGYCARGG (SEQ ID NO: 18527) |
| 146 | A + CAATCCC + C + AAGYCARGG (SEQ ID NO: 18528) |
| 146 | AC + AATCCC + C + AAGYCARGG (SEQ ID NO: 18529) |
| 146 | ACAAT + CCC + C + AAGYCARGG (SEQ ID NO: 18530) |
| 146 | ACAATCCC + C + AAGYCAR + GG (SEQ ID NO: 18531) |
| 146 | ACAATCCC + C + A + AGYCARGG (SEQ ID NO: 18532) |
| 146 | ACAATCCC + C + AAGY + CARGG (SEQ ID NO: 18533) |
| 146 | ACAATCCC + C + AAGYCA + RGG (SEQ ID NO: 18534) |
| 146 | CAATCCC + C + AAGYCARGG (SEQ ID NO: 18535) |
| 146 | CAAT + CCCCAAGYCARGG (SEQ ID NO: 18536) |

TABLE 13-continued

| | | |
|---|---|---|
| 146 | CAATCC + CCAAGYCARGG | (SEQ ID NO: 18537) |
| 146 | CAA + TCCCCAAGYCARGG | (SEQ ID NO: 18538) |
| 146 | CA + ATCCCCAAGYCARGG | (SEQ ID NO: 18539) |
| 146 | CAATCCCCAAGYCA + RGG | (SEQ ID NO: 18540) |
| 146 | CAATCCCC + AAGYCARGG | (SEQ ID NO: 18541) |
| 146 | CAATCCCCAAGYC + ARGG | (SEQ ID NO: 18542) |
| 146 | CAATCCCCAAGY + CARGG | (SEQ ID NO: 18543) |
| 146 | CAA + TCCC + C + AAGYCARGG | (SEQ ID NO: 18544) |
| 146 | +CAATCCC + C + AAGYCARGG | (SEQ ID NO: 18545) |
| 146 | C + AATCCC + C + AAGYCARGG | (SEQ ID NO: 18546) |
| 146 | CAAT + CCC + C + AAGYCARGG | (SEQ ID NO: 18547) |
| 146 | CAATCCC + C + AAGYCAR + GG | (SEQ ID NO: 18548) |
| 146 | CAATCCC + C + A + AGYCARGG | (SEQ ID NO: 18549) |
| 146 | CAATCCC + C + AAGY + CARGG | (SEQ ID NO: 18550) |
| 146 | CAATCCC + C + AAGYCA + RGG | (SEQ ID NO: 18551) |
| 146 | CAATCCC + C + AAGYCAR | (SEQ ID NO: 18552) |
| 146 | CAAT + CCCCAAGYCAR | (SEQ ID NO: 18553) |
| 146 | CAATCC + CCAAGYCAR | (SEQ ID NO: 18554) |
| 146 | CAA + TCCCCAAGYCAR | (SEQ ID NO: 18555) |
| 146 | CA + ATCCCCAAGYCAR | (SEQ ID NO: 18556) |
| 146 | CAATCCCCAAGYCA + R | (SEQ ID NO: 18557) |
| 146 | CAATCCCC + AAGYCAR | (SEQ ID NO: 18558) |
| 146 | CAATCCCCAAGYC + AR | (SEQ ID NO: 18559) |
| 146 | CAATCCCCAAGY + CAR | (SEQ ID NO: 18560) |
| 146 | CAA + TCCC + C + AAGYCAR | (SEQ ID NO: 18561) |
| 146 | +CAATCCC + C + AAGYCAR | (SEQ ID NO: 18562) |
| 146 | C + AATCCC + C + AAGYCAR | (SEQ ID NO: 18563) |
| 146 | CAAT + CCC + C + AAGYCAR | (SEQ ID NO: 18564) |
| 146 | CAATCCC + C + AAGYCAR | (SEQ ID NO: 18565) |
| 146 | CAATCCC + C + A + AGYCAR | (SEQ ID NO: 18566) |
| 146 | CAATCCC + C + AAGY + CAR | (SEQ ID NO: 18567) |
| 146 | CAATCCC + C + AAGYCA + R | (SEQ ID NO: 18568) |
| 146 | CAATCCC + C + AAGYC | (SEQ ID NO: 18569) |
| 146 | CAAT + CCCCAAGYC | (SEQ ID NO: 18570) |
| 146 | CAATCC + CCAAGYC | (SEQ ID NO: 18571) |
| 146 | CAA + TCCCCAAGYC | (SEQ ID NO: 18572) |
| 146 | CA + ATCCCCAAGYC | (SEQ ID NO: 18573) |
| 146 | CAATCCCCAAGYCA | (SEQ ID NO: 18574) |
| 146 | CAATCCCC + AAGYC | (SEQ ID NO: 18575) |
| 146 | CAATCCCCAAGYC | (SEQ ID NO: 18576) |
| 146 | CAATCCCCAAGY + C | (SEQ ID NO: 18577) |
| 146 | CAA + TCCC + C + AAGYC | (SEQ ID NO: 18578) |
| 146 | +CAATCCC + C + AAGYC | (SEQ ID NO: 18579) |
| 146 | C + AATCCC + C + AAGYC | (SEQ ID NO: 18580) |
| 146 | CAAT + CCC + C + AAGYC | (SEQ ID NO: 18581) |
| 146 | CAATCCC + C + AAGYCA | (SEQ ID NO: 18582) |
| 146 | CAATCCC + C + A + AGYC | (SEQ ID NO: 18583) |
| 146 | CAATCCC + C + AAGY + C | (SEQ ID NO: 18584) |
| 146 | ACAATCCCCAAGYCARGG | (SEQ ID NO: 18585) |
| 146 | CAATCCCCAAGYCARGG | (SEQ ID NO: 18586) |
| 146 | CAATCCCCAAGYCAR | (SEQ ID NO: 18587) |
| 146 | CAATCCCCAAGYC | (SEQ ID NO: 18588) |
| 146 | AATCCCCRAGTCAA | (SEQ ID NO: 18589) |
| 147 | AATCCCCA + A + GYCARGGAG | (SEQ ID NO: 18590) |
| 147 | AATCCCC + AAGYCARGGAG | (SEQ ID NO: 18591) |
| 147 | AAT + CCCCAAGYCARGGAG | (SEQ ID NO: 18592) |
| 147 | AATCCC + CAAGYCARGGAG | (SEQ ID NO: 18593) |
| 147 | AATCC + CCAAGYCARGGAG | (SEQ ID NO: 18594) |
| 147 | AATCCCCAAGYCARG + GAG | (SEQ ID NO: 18595) |
| 147 | AATCCCCAAGYCARGG + AG | (SEQ ID NO: 18596) |
| 147 | AATCCCCAAGYCARGGA + G | (SEQ ID NO: 18597) |
| 147 | AATCCCCAAGY + CARGGAG | (SEQ ID NO: 18598) |
| 147 | A + ATCCCCA + A + GYCARGGAG | (SEQ ID NO: 18599) |
| 147 | AATCCC + CA + A + GYCARGGAG | (SEQ ID NO: 18600) |
| 147 | AATC + CCCA + A + GYCARGGAG | (SEQ ID NO: 18601) |
| 147 | AAT + CCCCA + A + GYCARGGAG | (SEQ ID NO: 18602) |
| 147 | AATCCCCA + A + GYCA + RGGAG | (SEQ ID NO: 18603) |
| 147 | AATCCCCA + A + G + YCARGGAG | (SEQ ID NO: 18604) |
| 147 | AATCCCCA + A + GY + CARGGAG | (SEQ ID NO: 18605) |
| 147 | AATCCCCA + A + GYCARGG + AG | (SEQ ID NO: 18606) |
| 147 | ATCCCCA + A + GYCARGGAG | (SEQ ID NO: 18607) |
| 147 | ATCCCC + AAGYCARGGAG | (SEQ ID NO: 18608) |

TABLE 13-continued

| | |
|---|---|
| 147 | AT + CCCCAAGYCARGGAG (SEQ ID NO: 18609) |
| 147 | ATCCC + CAAGYCARGGAG (SEQ ID NO: 18610) |
| 147 | ATCC + CCAAGYCARGGAG (SEQ ID NO: 18611) |
| 147 | ATCCCCAAGYCARG + GAG (SEQ ID NO: 18612) |
| 147 | ATCCCCAAGYCARGG + AG (SEQ ID NO: 18613) |
| 147 | ATCCCCAAGYCARGGA + G (SEQ ID NO: 18614) |
| 147 | ATCCCCAAGY + CARGGAG (SEQ ID NO: 18615) |
| 147 | +ATCCCCA + A + GYCARGGAG (SEQ ID NO: 18616) |
| 147 | ATCCC + CA + A + GYCARGGAG (SEQ ID NO: 18617) |
| 147 | ATC + CCCA + A + GYCARGGAG (SEQ ID NO: 18618) |
| 147 | AT + CCCCA + A + GYCARGGAG (SEQ ID NO: 18619) |
| 147 | ATCCCCA + A + GYCA + RGGAG (SEQ ID NO: 18620) |
| 147 | ATCCCCA + A + G + YCARGGAG (SEQ ID NO: 18621) |
| 147 | ATCCCCA + A + GY + CARGGAG (SEQ ID NO: 18622) |
| 147 | ATCCCCA + A + GYCARGG + AG (SEQ ID NO: 18623) |
| 147 | ATCCCCA + A + GYCARGG (SEQ ID NO: 18624) |
| 147 | ATCCCC + AAGYCARGG (SEQ ID NO: 18625) |
| 147 | AT + CCCCAAGYCARGG (SEQ ID NO: 18626) |
| 147 | ATCCC + CAAGYCARGG (SEQ ID NO: 18627) |
| 147 | ATCC + CCAAGYCARGG (SEQ ID NO: 18628) |
| 147 | ATCCCCAAGYCARG + G (SEQ ID NO: 18629) |
| 147 | ATCCCCAAGYCARGG (SEQ ID NO: 18630) |
| 147 | ATCCCCAAGYCARGGA (SEQ ID NO: 18631) |
| 147 | ATCCCCAAGY + CARGG (SEQ ID NO: 18632) |
| 147 | +ATCCCCA + A + GYCARGG (SEQ ID NO: 18633) |
| 147 | ATCCC + CA + A + GYCARGG (SEQ ID NO: 18634) |
| 147 | ATC + CCCA + A + GYCARGG (SEQ ID NO: 18635) |
| 147 | AT + CCCCA + A + GYCARGG (SEQ ID NO: 18636) |
| 147 | ATCCCCA + A + GYCA + RGG (SEQ ID NO: 18637) |
| 147 | ATCCCCA + A + G + YCARGG (SEQ ID NO: 18638) |
| 147 | ATCCCCA + A + GY + CARGG (SEQ ID NO: 18639) |
| 147 | ATCCCCA + A + GYCARGG (SEQ ID NO: 18640) |
| 147 | ATCCCCA + A + GYCAR (SEQ ID NO: 18641) |
| 147 | ATCCCC + AAGYCAR (SEQ ID NO: 18642) |
| 147 | AT + CCCCAAGYCAR (SEQ ID NO: 18643) |
| 147 | ATCCC + CAAGYCAR (SEQ ID NO: 18644) |
| 147 | ATCC + CCAAGYCAR (SEQ ID NO: 18645) |
| 147 | ATCCCCAAGYCARG (SEQ ID NO: 18646) |
| 147 | ATCCCCAAGY + CAR (SEQ ID NO: 18647) |
| 147 | +ATCCCCA + A + GYCAR (SEQ ID NO: 18648) |
| 147 | ATCCC + CA + A + GYCAR (SEQ ID NO: 18649) |
| 147 | ATC + CCCA + A + GYCAR (SEQ ID NO: 18650) |
| 147 | AT + CCCCA + A + GYCAR (SEQ ID NO: 18651) |
| 147 | ATCCCCA + A + GYCA + R (SEQ ID NO: 18652) |
| 147 | ATCCCCA + A + G + YCAR (SEQ ID NO: 18653) |
| 147 | ATCCCCA + A + GY + CAR (SEQ ID NO: 18654) |
| 147 | ATCCCCA + A + GYCARG (SEQ ID NO: 18655) |
| 147 | AATCCCCAAGYCARGGAG (SEQ ID NO: 18656) |
| 147 | ATCCCCAAGYCARGGAG (SEQ ID NO: 18657) |
| 147 | ATCCCCAAGYCARGG (SEQ ID NO: 18658) |
| 147 | ATCCCCAAGYCAR (SEQ ID NO: 18659) |
| 147 | TCCCCAAGGYCAAGG (SEQ ID NO: 18660) |
| 148 | CCAAAGYC + A + GGAGTAGTR (SEQ ID NO: 18661) |
| 148 | CCAAA + GYCAGGAGTAGTR (SEQ ID NO: 18662) |
| 148 | CCA + AAGYCAGGAGTAGTR (SEQ ID NO: 18663) |
| 148 | C + CAAAGYCAGGAGTAGTR (SEQ ID NO: 18664) |
| 148 | CC + AAAGYCAGGAGTAGTR (SEQ ID NO: 18665) |
| 148 | CCAAAGYCAGGAGT + AGTR (SEQ ID NO: 18666) |
| 148 | CCAAAGYCAGGAGTA + GTR (SEQ ID NO: 18667) |
| 148 | CCAAAGYCAGGA + GTAGTR (SEQ ID NO: 18668) |
| 148 | CCAAAGYCAG + GAGTAGTR (SEQ ID NO: 18669) |
| 148 | CCAAAGY + C + A + GGAGTAGTR (SEQ ID NO: 18670) |
| 148 | CCA + AAGYC + A + GGAGTAGTR (SEQ ID NO: 18671) |
| 148 | CC + AAAGYC + A + GGAGTAGTR (SEQ ID NO: 18672) |
| 148 | CCAA + AGYC + A + GGAGTAGTR (SEQ ID NO: 18673) |
| 148 | CCAAAGYC + A + GG + AGTAGTR (SEQ ID NO: 18674) |
| 148 | CCAAAGYC + A + GGAG + TAGTR (SEQ ID NO: 18675) |
| 148 | CCAAAGYC + A + GGAGTAGT + R (SEQ ID NO: 18676) |
| 148 | CCAAAGYC + A + GGAGT + AGTR (SEQ ID NO: 18677) |
| 148 | CCCCAAAG + Y + ARGGAGTAG (SEQ ID NO: 18678) |
| 148 | CCC + CAAAGYARGGAGTAG (SEQ ID NO: 18679) |
| 148 | CCCCA + AAGYARGGAGTAG (SEQ ID NO: 18680) |
| 148 | CCCCAAAG + YARGGAGTAG (SEQ ID NO: 18681) |

TABLE 13-continued

| | | |
|---|---|---|
| 148 | CCCCAAA + GYARGGAGTAG (SEQ ID NO: 18682) | |
| 148 | CCCCAAAGYARGGAG + TAG (SEQ ID NO: 18683) | |
| 148 | CCCCAAAGYARG + GAGTAG (SEQ ID NO: 18684) | |
| 148 | CCCCAAAGY + ARGGAGTAG (SEQ ID NO: 18685) | |
| 148 | CCCCAAAGYAR + GGAGTAG (SEQ ID NO: 18686) | |
| 148 | CCC + CAAAG + Y + ARGGAGTAG (SEQ ID NO: 18687) | |
| 148 | CCCCA + AAG + Y + ARGGAGTAG (SEQ ID NO: 18688) | |
| 148 | CC + CCAAAG + Y + ARGGAGTAG (SEQ ID NO: 18689) | |
| 148 | CCCC + AAAG + Y + ARGGAGTAG (SEQ ID NO: 18690) | |
| 148 | CCCCAAAG + Y + AR + GGAGTAG (SEQ ID NO: 18691) | |
| 148 | CCCCAAAG + Y + ARGGA + GTAG (SEQ ID NO: 18692) | |
| 148 | CCCCAAAG + Y + ARGGAG + TAG (SEQ ID NO: 18693) | |
| 148 | CCCCAAAG + Y + ARGGAGTA + G (SEQ ID NO: 18694) | |
| 148 | CCCAAAGY + C + RGGAGTAGT (SEQ ID NO: 18695) | |
| 148 | CCCAA + AGYCRGGAGTAGT (SEQ ID NO: 18696) | |
| 148 | CCC + AAAGYCRGGAGTAGT (SEQ ID NO: 18697) | |
| 148 | CCCAAAG + YCRGGAGTAGT (SEQ ID NO: 18698) | |
| 148 | CCCAAAGY + CRGGAGTAGT (SEQ ID NO: 18699) | |
| 148 | CCCAAAGYCRGGAG + TAGT (SEQ ID NO: 18700) | |
| 148 | CCCAAAGYCRGGAGTA + GT (SEQ ID NO: 18701) | |
| 148 | CCCAAAGYCRGG + AGTAGT (SEQ ID NO: 18702) | |
| 148 | CCCAAAGYCR + GGAGTAGT (SEQ ID NO: 18703) | |
| 148 | CCCAAAG + Y + C + RGGAGTAGT (SEQ ID NO: 18704) | |
| 148 | CC + CAAAGY + C + RGGAGTAGT (SEQ ID NO: 18705) | |
| 148 | CCCAAA + GY + C + RGGAGTAGT (SEQ ID NO: 18706) | |
| 148 | C + CCAAAGY + C + RGGAGTAGT (SEQ ID NO: 18707) | |
| 148 | CCCAAAGY + C + RGG + AGTAGT (SEQ ID NO: 18708) | |
| 148 | CCCAAAGY + C + R + GGAGTAGT (SEQ ID NO: 18709) | |
| 148 | CCCAAAGY + C + RGGAG + TAGT (SEQ ID NO: 18710) | |
| 148 | CCCAAAGY + C + RGGAGT + AGT (SEQ ID NO: 18711) | |
| 148 | CAAAGYC + A + GGAGTAGTR (SEQ ID NO: 18712) | |
| 148 | CAAA + GYCAGGAGTAGTR (SEQ ID NO: 18713) | |
| 148 | CA + AAGYCAGGAGTAGTR (SEQ ID NO: 18714) | |
| 148 | +CAAAGYCAGGAGTAGTR (SEQ ID NO: 18715) | |
| 148 | C + AAAGYCAGGAGTAGTR (SEQ ID NO: 18716) | |
| 148 | CAAAGYCAGGAGT + AGTR (SEQ ID NO: 18717) | |
| 148 | CAAAGYCAGGAGTA + GTR (SEQ ID NO: 18718) | |
| 148 | CAAAGYCAGGA + GTAGTR (SEQ ID NO: 18719) | |
| 148 | CAAAGYCAG + GAGTAGTR (SEQ ID NO: 18720) | |
| 148 | CAAAGY + C + A + GGAGTAGTR (SEQ ID NO: 18721) | |
| 148 | CA + AAGYC + A + GGAGTAGTR (SEQ ID NO: 18722) | |
| 148 | C + AAAGYC + A + GGAGTAGTR (SEQ ID NO: 18723) | |
| 148 | CAA + AGYC + A + GGAGTAGTR (SEQ ID NO: 18724) | |
| 148 | CAAAGYC + A + GG + AGTAGTR (SEQ ID NO: 18725) | |
| 148 | CAAAGYC + A + GGAG + TAGTR (SEQ ID NO: 18726) | |
| 148 | CAAAGYC + A + GGAGTAGT + R (SEQ ID NO: 18727) | |
| 148 | CAAAGYC + A + GGAGT + AGTR (SEQ ID NO: 18728) | |
| 148 | CCCAAAG + Y + ARGGAGTAG (SEQ ID NO: 18729) | |
| 148 | CC + CAAAGYARGGAGTAG (SEQ ID NO: 18730) | |
| 148 | CCCA + AAGYARGGAGTAG (SEQ ID NO: 18731) | |
| 148 | CCCAAAG + YARGGAGTAG (SEQ ID NO: 18732) | |
| 148 | CCCAAA + GYARGGAGTAG (SEQ ID NO: 18733) | |
| 148 | CCCAAAGYARGGAG + TAG (SEQ ID NO: 18734) | |
| 148 | CCCAAAGYARG + GAGTAG (SEQ ID NO: 18735) | |
| 148 | CCCAAAGY + ARGGAGTAG (SEQ ID NO: 18736) | |
| 148 | CCCAAAGYAR + GGAGTAG (SEQ ID NO: 18737) | |
| 148 | CC + CAAAG + Y + ARGGAGTAG (SEQ ID NO: 18738) | |
| 148 | CCCA + AAG + Y + ARGGAGTAG (SEQ ID NO: 18739) | |
| 148 | C + CCAAAG + Y + ARGGAGTAG (SEQ ID NO: 18740) | |
| 148 | CC C + AAAG + Y + ARGGAGTAG (SEQ ID NO: 18741) | |
| 148 | CCCAAAG + Y + AR + GGAGTAG (SEQ ID NO: 18742) | |
| 148 | CCCAAAG + Y + ARGGA + GTAG (SEQ ID NO: 18743) | |
| 148 | CCCAAAG + Y + ARGGAG + TAG (SEQ ID NO: 18744) | |
| 148 | CCCAAAG + Y + ARGGAGTA + G (SEQ ID NO: 18745) | |

TABLE 13-continued

| 148 | CCAAAGY + C + RGGAGTAGT (SEQ ID NO: 18746) |
| --- | --- |
| 148 | CCAA + AGYCRGGAGTAGT (SEQ ID NO: 18747) |
| 148 | CC + AAAGYCRGGAGTAGT (SEQ ID NO: 18748) |
| 148 | CCAAAG + YCRGGAGTAGT (SEQ ID NO: 18749) |
| 148 | CCAAAGY + CRGGAGTAGT (SEQ ID NO: 18750) |
| 148 | CCAAAGYCRGGAG + TAGT (SEQ ID NO: 18751) |
| 148 | CCAAAGYCRGGAGTA + GT (SEQ ID NO: 18752) |
| 148 | CCAAAGYCRGG + AGTAGT (SEQ ID NO: 18753) |
| 148 | CCAAAGYCR + GGAGTAGT (SEQ ID NO: 18754) |
| 148 | CCAAAG + Y + C + RGGAGTAGT (SEQ ID NO: 18755) |
| 148 | C + CAAAGY + C + RGGAGTAGT (SEQ ID NO: 18756) |
| 148 | CCAAA + GY + C + RGGAGTAGT (SEQ ID NO: 18757) |
| 148 | +CCAAAGY + C + RGGAGTAGT (SEQ ID NO: 18758) |
| 148 | CCAAAGY + C + RGG + AGTAGT (SEQ ID NO: 18759) |
| 148 | CCAAAGY + C + R + GGAGTAGT (SEQ ID NO: 18760) |
| 148 | CCAAAGY + C + RGGAG + TAGT (SEQ ID NO: 18761) |
| 148 | CCAAAGY + C + RGGAGT + AGT (SEQ ID NO: 18762) |
| 148 | CAAAGYC + A + GGAGTAG (SEQ ID NO: 18763) |
| 148 | CAAA + GYCAGGAGTAG (SEQ ID NO: 18764) |
| 148 | CA + AAGYCAGGAGTAG (SEQ ID NO: 18765) |
| 148 | +CAAAGYCAGGAGTAG (SEQ ID NO: 18766) |
| 148 | C + AAAGYCAGGAGTAG (SEQ ID NO: 18767) |
| 148 | CAAAGYCAGGAGT + AG (SEQ ID NO: 18768) |
| 148 | CAAAGYCAGGAGTA + G (SEQ ID NO: 18769) |
| 148 | CAAAGYCAGGA + GTAG (SEQ ID NO: 18770) |
| 148 | CAAAGYCAG + GAGTAG (SEQ ID NO: 18771) |
| 148 | CAAAGY + C + A + GGAGTAG (SEQ ID NO: 18772) |
| 148 | CA + AAGYC + A + GGAGTAG (SEQ ID NO: 18773) |
| 148 | C + AAAGYC + A + GGAGTAG (SEQ ID NO: 18774) |
| 148 | CAA + AGYC + A + GGAGTAG (SEQ ID NO: 18775) |
| 148 | CAAAGYC + A + GG + AGTAG (SEQ ID NO: 18776) |
| 148 | CAAAGYC + A + GGAG + TAG (SEQ ID NO: 18777) |
| 148 | CAAAGYC + A + GGAGTAGT (SEQ ID NO: 18778) |
| 148 | CAAAGYC + A + GGAGT + AG (SEQ ID NO: 18779) |
| 148 | CCCAAAG + Y + ARGGAGT (SEQ ID NO: 18780) |
| 148 | CC + CAAAGYARGGAGT (SEQ ID NO: 18781) |
| 148 | CCCA + AAGYARGGAGT (SEQ ID NO: 18782) |
| 148 | CCCAAAG + YARGGAGT (SEQ ID NO: 18783) |
| 148 | CCCAAA + GYARGGAGT (SEQ ID NO: 18784) |
| 148 | CCCAAAGYARGGAG + T (SEQ ID NO: 18785) |
| 148 | CCCAAAGYARG + GAGT (SEQ ID NO: 18786) |
| 148 | CCCAAAGY + ARGGAGT (SEQ ID NO: 18787) |
| 148 | CCCAAAGYAR + GGAGT (SEQ ID NO: 18788) |
| 148 | CC + CAAAG + Y + ARGGAGT (SEQ ID NO: 18789) |
| 148 | CCCA + AAG + Y + ARGGAGT (SEQ ID NO: 18790) |
| 148 | C + CCAAAG + Y + ARGGAGT (SEQ ID NO: 18791) |
| 148 | CCC + AAAG + Y + ARGGAGT (SEQ ID NO: 18792) |
| 148 | CCCAAAG + Y + AR + GGAGT (SEQ ID NO: 18793) |
| 148 | CCCAAAG + Y + ARGGA + GT (SEQ ID NO: 18794) |
| 148 | CCCAAAG + Y + ARGGAG + T (SEQ ID NO: 18795) |
| 148 | CCCAAAG + Y + ARGGAGTA (SEQ ID NO: 18796) |
| 148 | CCAAAGY + C + RGGAGTA (SEQ ID NO: 18797) |
| 148 | CCAA + AGYCRGGAGTA (SEQ ID NO: 18798) |
| 148 | CC + AAAGYCRGGAGTA (SEQ ID NO: 18799) |
| 148 | CCAAAG + YCRGGAGTA (SEQ ID NO: 18800) |
| 148 | CCAAAGY + CRGGAGTA (SEQ ID NO: 18801) |
| 148 | CCAAAGYCRGGAG + TA (SEQ ID NO: 18802) |
| 148 | CCAAAGYCRGGAGTA (SEQ ID NO: 18803) |
| 148 | CCAAAGYCRGG + AGTA (SEQ ID NO: 18804) |
| 148 | CCAAAGYCR + GGAGTA (SEQ ID NO: 18805) |
| 148 | CCAAAG + Y + C + RGGAGTA (SEQ ID NO: 18806) |
| 148 | C + CAAAGY + C + RGGAGTA (SEQ ID NO: 18807) |
| 148 | CCAAA + GY + C + RGGAGTA (SEQ ID NO: 18808) |
| 148 | +CCAAAGY + C + RGGAGTA (SEQ ID NO: 18809) |
| 148 | CCAAAGY + C + RGG + AGTA (SEQ ID NO: 18810) |
| 148 | CCAAAGY + C + R + GGAGTA (SEQ ID NO: 18811) |
| 148 | CCAAAGY + C + RGGAG + TA (SEQ ID NO: 18812) |
| 148 | CCAAAGY + C + RGGAGT + A (SEQ ID NO: 18813) |
| 148 | CAAAGYC + A + GGAGT (SEQ ID NO: 18814) |
| 148 | CAAA + GYCAGGAGT (SEQ ID NO: 18815) |
| 148 | CA + AAGYCAGGAGT (SEQ ID NO: 18816) |
| 148 | +CAAAGYCAGGAGT (SEQ ID NO: 18817) |
| 148 | C + AAAGYCAGGAGT (SEQ ID NO: 18818) |
| 148 | CAAAGYCAGGAGT (SEQ ID NO: 18819) |
| 148 | CAAAGYCAGGAGTA (SEQ ID NO: 18820) |
| 148 | CAAAGYCAGGA + GT (SEQ ID NO: 18821) |

TABLE 13-continued

| | |
|---|---|
| 148 | CAAAGYCAG + GAGT (SEQ ID NO:1 8822) |
| 148 | CAAAGY + C + A + GGAGT (SEQ ID NO: 18823) |
| 148 | CA + AAGYC + A + GGAGT (SEQ ID NO: 18824) |
| 148 | C + AAAGYC + A + GGAGT (SEQ ID NO: 18825) |
| 148 | CAA + AGYC + A + GGAGT (SEQ ID NO: 18826) |
| 148 | CAAAGYC + A + GG + AGT (SEQ ID NO: 18827) |
| 148 | CAAAGYC + A + GGAG + T (SEQ ID NO: 18828) |
| 148 | CAAAGYC + A + GGAGTA (SEQ ID NO: 18829) |
| 148 | CAAAGYC + A + GGAGT (SEQ ID NO: 18830) |
| 148 | CCCAAAG + Y + ARGGA (SEQ ID NO: 18831) |
| 148 | CC + CAAAGYARGGA (SEQ ID NO: 18832) |
| 148 | CCCA + AAGYARGGA (SEQ ID NO: 18833) |
| 148 | CCCAAAG + YARGGA (SEQ ID NO: 18834) |
| 148 | CCCAAA + GYARGGA (SEQ ID NO: 18835) |
| 148 | CCCAAAGYARGGAG (SEQ ID NO: 18836) |
| 148 | CCCAAAGYARG + GA (SEQ ID NO: 18837) |
| 148 | CC CAAAGY + ARGGA (SEQ ID NO: 18838) |
| 148 | CCCAAAGYAR + GGA (SEQ ID NO: 18839) |
| 148 | CC + CAAAG + Y + ARGGA (SEQ ID NO: 18840) |
| 148 | CCCA + AAG + Y + ARGGA (SEQ ID NO: 18841) |
| 148 | C + CCAAAG + Y + ARGGA (SEQ ID NO: 18842) |
| 148 | CCC + AAAG + Y + ARGGA (SEQ ID NO: 18843) |
| 148 | CCCAAAG + Y + AR + GGA (SEQ ID NO: 18844) |
| 148 | CCCAAAG + Y + ARGGA (SEQ ID NO: 18845) |
| 148 | CCCAAAG + Y + ARGGAG (SEQ ID NO: 18846) |
| 148 | CCAAAGY + C + RGGAG (SEQ ID NO: 18847) |
| 148 | CCAA + AGYCRGGAG (SEQ ID NO: 18848) |
| 148 | CC + AAAGYCRGGAG (SEQ ID NO: 18849) |
| 148 | CCAAAG + YCRGGAG (SEQ ID NO: 18850) |
| 148 | CCAAAGY + CRGGAG (SEQ ID NO: 18851) |
| 148 | CCAAAGYCRGGAG (SEQ ID NO: 18852) |
| 148 | CCAAAGYCRGGAGT (SEQ ID NO: 18853) |
| 148 | CCAAAGYCRGG + AG (SEQ ID NO: 18854) |
| 148 | CCAAAGYCR + GGAG (SEQ ID NO: 18855) |
| 148 | CCAAAG + Y + C + RGGAG (SEQ ID NO: 18856) |
| 148 | C + CAAAGY + C + RGGAG (SEQ ID NO: 18857) |
| 148 | CCAAA + GY + C + RGGAG (SEQ ID NO: 18858) |
| 148 | +CCAAAGY + C + RGGAG (SEQ ID NO: 18859) |
| 148 | CCAAAGY + C + RGG + AG (SEQ ID NO: 18860) |
| 148 | CCAAAGY + C + R + GGAG (SEQ ID NO: 18861) |
| 148 | CCAAAGY + C + RGGAG (SEQ ID NO: 18862) |
| 148 | CCAAAGY + C + RGGAGT (SEQ ID NO: 18863) |
| 148 | CCAAAGYCAGGAGTAGTR (SEQ ID NO: 18864) |
| 148 | CCCCAAAGYARGGAGTAG (SEQ ID NO: 18865) |
| 148 | CCCAAAGYCRGGAGTAGT (SEQ ID NO: 18866) |
| 148 | CAAAGYCAGGAGTAGTR (SEQ ID NO: 18867) |
| 148 | CCCAAAGYARGGAGTAG (SEQ ID NO: 18868) |
| 148 | CCAAAGYCRGGAGTAGT (SEQ ID NO: 18869) |
| 148 | CAAAGYCAGGAGTAG (SEQ ID NO: 18870) |
| 148 | CAAAGYCAGGAGTAGT (SEQ ID NO: 18871) |
| 148 | CCCAAAGYARGGAGT (SEQ ID NO: 18872) |
| 148 | CCCAAAGYARGGAGTA (SEQ ID NO: 18873) |
| 148 | CCAAAGYCRGGAGTA (SEQ ID NO: 18874) |
| 148 | CAAAGYCAGGAGT (SEQ ID NO: 18875) |
| 148 | CCCAAAGYARGGA (SEQ ID NO: 18876) |
| 148 | CCAAAGYCRGGAG (SEQ ID NO: 18877) |
| 148 | CAAAGTCAYGGAGTA (SEQ ID NO: 18878) |
| 148 | CAAAGTMGRGGAGTA (SEQ ID NO: 18879) |
| 148 | CAAAGTAARGGAGTA (SEQ ID NO: 18880) |
| 153 | ATTCATRTATTCTAC (SEQ ID NO: 18881) |
| 153 | ATTCATRAATTCTAC (SEQ ID NO: 18882) |
| 155 | GARTCYAT + G + ATAARGAAT (SEQ ID NO: 18883) |
| 155 | GARTCYAT + GATAARGAAT (SEQ ID NO: 18884) |
| 155 | G + ARTCYATGATAARGAAT (SEQ ID NO: 18885) |
| 155 | GARTCY + ATGATAARGAAT (SEQ ID NO: 18886) |
| 155 | GART + CYATGATAARGAAT (SEQ ID NO: 18887) |
| 155 | GARTCYATGATAAR + GAAT (SEQ ID NO: 18888) |
| 155 | GARTCYATGATAARGA + AT (SEQ ID NO: 18889) |
| 155 | GARTCYATGATAA + RGAAT (SEQ ID NO: 18890) |
| 155 | GARTCYATGA + TAARGAAT (SEQ ID NO: 18891) |
| 155 | GARTCYA + T + G + ATAARGAAT (SEQ ID NO: 18892) |
| 155 | G + ARTCYAT + G + ATAARGAAT (SEQ ID NO: 18893) |
| 155 | GAR + TCYAT + G + ATAARGAAT (SEQ ID NO: 18894) |
| 155 | GART + CYAT + G + ATAARGAAT (SEQ ID NO: 18895) |
| 155 | GARTCYAT + G + AT + AARGAAT (SEQ ID NO: 18896) |
| 155 | GARTCYAT + G + ATA + ARGAAT (SEQ ID NO: 18897) |
| 155 | GARTCYAT + G + ATAARGA + AT (SEQ ID NO: 18898) |

TABLE 13-continued

| | |
|---|---|
| 155 | GARTCYAT + G + ATAARG + AAT (SEQ ID NO: 18899) |
| 155 | ARTCYATG + A + TAARGAATT (SEQ ID NO: 18900) |
| 155 | ART + CYATGATAARGAATT (SEQ ID NO: 18901) |
| 155 | ARTCY + ATGATAARGAATT (SEQ ID NO: 18902) |
| 155 | AR + TCYATGATAARGAATT (SEQ ID NO: 18903) |
| 155 | A + RTCYATGATAARGAATT (SEQ ID NO: 18904) |
| 155 | ARTCYATGATAARGAAT + T (SEQ ID NO: 18905) |
| 155 | ARTCYATGA + TAARGAATT (SEQ ID NO: 18906) |
| 155 | ARTCYATGATAAR + GAATT (SEQ ID NO: 18907) |
| 155 | ARTCYATGATAARG + AATT (SEQ ID NO: 18908) |
| 155 | AR + TCYATG + A + TAARGAATT (SEQ ID NO: 18909) |
| 155 | ARTCYA + TG + A + TAARGAATT (SEQ ID NO: 18910) |
| 155 | ARTCY + ATG + A + TAARGAATT (SEQ ID NO: 18911) |
| 155 | ARTCYAT + G + A + TAARGAATT (SEQ ID NO: 18912) |
| 155 | ARTCYATG + A + TAAR + GAATT (SEQ ID NO: 18913) |
| 155 | ARTCYATG + A + TAARGA + ATT (SEQ ID NO: 18914) |
| 155 | ARTCYATG + A + TAARGAA + TT (SEQ ID NO: 18915) |
| 155 | ARTCYATG + A + TA + ARGAATT (SEQ ID NO: 18916) |
| 155 | ARTCYAT + G + ATAARGAAT (SEQ ID NO: 18917) |
| 155 | ARTCYAT + GATAARGAAT (SEQ ID NO: 18918) |
| 155 | +ARTCYATGATAARGAAT (SEQ ID NO: 18919) |
| 155 | ARTCY + ATGATAARGAAT (SEQ ID NO: 18920) |
| 155 | ART + CYATGATAARGAAT (SEQ ID NO: 18921) |
| 155 | ARTCYATGATAAR + GAAT (SEQ ID NO: 18922) |
| 155 | ARTCYATGATAARGA + AT (SEQ ID NO: 18923) |
| 155 | ARTCYATGATAA + RGAAT (SEQ ID NO: 18924) |
| 155 | ARTCYATGA + TAARGAAT (SEQ ID NO: 18925) |
| 155 | ARTCYA + T + G + ATAARGAAT (SEQ ID NO: 18926) |
| 155 | +ARTCYAT + G + ATAARGAAT (SEQ ID NO: 18927) |
| 155 | AR + TCYAT + G + ATAARGAAT (SEQ ID NO: 18928) |
| 155 | ART + CYAT + G + ATAARGAAT (SEQ ID NO: 18929) |
| 155 | ARTCYAT + G + AT + AARGAAT (SEQ ID NO: 18930) |
| 155 | ARTCYAT + G + ATA + ARGAAT (SEQ ID NO: 18931) |
| 155 | ARTCYAT + G + ATAARGA + AT (SEQ ID NO: 18932) |
| 155 | ARTCYAT + G + ATAARG + AAT (SEQ ID NO: 18933) |
| 155 | RTCYATG + A + TAARGAATT (SEQ ID NO: 18934) |
| 155 | RT + CYATGATAARGAATT (SEQ ID NO: 18935) |
| 155 | RTCY + ATGATAARGAATT (SEQ ID NO: 18936) |
| 155 | R + TCYATGATAARGAATT (SEQ ID NO: 18937) |
| 155 | +RTCYATGATAARGAATT (SEQ ID NO: 18938) |
| 155 | RTCYATGATAARGAAT + T (SEQ ID NO: 18939) |
| 155 | RTCYATGA + TAARGAATT (SEQ ID NO: 18940) |
| 155 | RTCYATGATAAR + GAATT (SEQ ID NO: 18941) |
| 155 | RTCYATGATAARG + AATT (SEQ ID NO: 18942) |
| 155 | R + TCYATG + A + TAARGAATT (SEQ ID NO: 18943) |
| 155 | RTCYA + TG + A + TAARGAATT (SEQ ID NO: 18944) |
| 155 | RTCY + ATG + A + TAARGAATT (SEQ ID NO: 18945) |
| 155 | RTCYAT + G + A + TAARGAATT (SEQ ID NO: 18946) |
| 155 | RTCYATG + A + TAAR + GAATT (SEQ ID NO: 18947) |
| 155 | RTCYATG + A + TAARGA + ATT (SEQ ID NO: 18948) |
| 155 | RTCYATG + A + TAARGAA + TT (SEQ ID NO: 18949) |
| 155 | RTCYATG + A + TA + ARGAATT (SEQ ID NO: 18950) |
| 155 | ARTCYAT + G + ATAARGA (SEQ ID NO: 18951) |
| 155 | ARTCYAT + GATAARGA (SEQ ID NO: 18952) |
| 155 | +ARTCYATGATAARGA (SEQ ID NO: 18953) |
| 155 | ARTCY + ATGATAARGA (SEQ ID NO: 18954) |
| 155 | ART + CYATGATAARGA (SEQ ID NO: 18955) |
| 155 | ARTCYATGATAAR + GA (SEQ ID NO: 18956) |
| 155 | ARTCYATGATAARGA (SEQ ID NO: 18957) |
| 155 | ARTCYATGATAA + RGA (SEQ ID NO: 18958) |
| 155 | ARTCYATGA + TAARGA (SEQ ID NO: 18959) |
| 155 | ARTCYA + T + G + ATAARGA (SEQ ID NO: 18960) |
| 155 | +ARTCYAT + G + ATAARGA (SEQ ID NO: 18961) |
| 155 | AR + TCYAT + G + ATAARGA (SEQ ID NO: 18962) |
| 155 | ART + CYAT + G + ATAARGA (SEQ ID NO: 18963) |
| 155 | ARTCYAT + G + AT + AARGA (SEQ ID NO: 18964) |
| 155 | ARTCYAT + G + ATA + ARGA (SEQ ID NO: 18965) |
| 155 | ARTCYAT + G + ATAARGA (SEQ ID NO: 18966) |

TABLE 13-continued

| | |
|---|---|
| 155 | ARTCYAT + G + ATAARG + A (SEQ ID NO: 18967) |
| 155 | RTCYATG + A + TAARGAA (SEQ ID NO: 18968) |
| 155 | RT + CYATGATAARGAA (SEQ ID NO: 18969) |
| 155 | RTCY + ATGATAARGAA (SEQ ID NO: 18970) |
| 155 | R + TCYATGATAARGAA (SEQ ID NO: 18971) |
| 155 | +RTCYATGATAARGAA (SEQ ID NO: 18972) |
| 155 | RTCYATGATAARGAAT (SEQ ID NO: 18973) |
| 155 | RTCYATGA + TAARGAA (SEQ ID NO: 18974) |
| 155 | RTCYATGATAAR + GAA (SEQ ID NO: 18975) |
| 155 | RTCYATGATAARG + AA (SEQ ID NO: 18976) |
| 155 | R + TCYATG + A + TAARGAA (SEQ ID NO: 18977) |
| 155 | RTCYA + TG + A + TAARGAA (SEQ ID NO: 18978) |
| 155 | RTCY + ATG + A + TAARGAA (SEQ ID NO: 18979) |
| 155 | RTCYAT + G + A + TAARGAA (SEQ ID NO: 18980) |
| 155 | RTCYATG + A + TAAR + GAA (SEQ ID NO: 18981) |
| 155 | RTCYATG + A + TAARGA + A (SEQ ID NO: 18982) |
| 155 | RTCYATG + A + TAARGAA (SEQ ID NO: 18983) |
| 155 | RTCYATG + A + TA + ARGAA (SEQ ID NO: 18984) |
| 155 | ARTCYAT + G + ATAAR (SEQ ID NO: 18985) |
| 155 | ARTCYAT + GATAAR (SEQ ID NO: 18986) |
| 155 | +ARTCYATGATAAR (SEQ ID NO: 18987) |
| 155 | ARTCY + ATGATAAR (SEQ ID NO: 18988) |
| 155 | ART + CYATGATAAR (SEQ ID NO: 18989) |
| 155 | ARTCYATGATAAR (SEQ ID NO: 18990) |
| 155 | ARTCYATGATAARG (SEQ ID NO: 18991) |
| 155 | ARTCYATGATAA + R (SEQ ID NO: 18992) |
| 155 | ARTCYATGA + TAAR (SEQ ID NO: 18993) |
| 155 | ARTCYA + T + G + ATAAR (SEQ ID NO: 18994) |
| 155 | +ARTCYAT + G + ATAAR (SEQ ID NO: 18995) |
| 155 | AR + TCYAT + G + ATAAR (SEQ ID NO: 18996) |
| 155 | ART + CYAT + G + ATAAR (SEQ ID NO: 18997) |
| 155 | ARTCYAT + G + AT + AAR (SEQ ID NO: 18998) |
| 155 | ARTCYAT + G + ATA + AR (SEQ ID NO: 18999) |
| 155 | ARTCYAT + G + ATAARG (SEQ ID NO: 19000) |
| 155 | RTCYATG + A + TAARG (SEQ ID NO: 19001) |
| 155 | RT + CYATGATAARG (SEQ ID NO: 19002) |
| 155 | RTCY + ATGATAARG (SEQ ID NO: 19003) |
| 155 | R + TCYATGATAARG (SEQ ID NO: 19004) |
| 155 | +RTCYATGATAARG (SEQ ID NO: 19005) |
| 155 | RTCYATGATAARGA (SEQ ID NO: 19006) |
| 155 | RTCYATGA + TAARG (SEQ ID NO: 19007) |
| 155 | RTCYATGATAAR + G (SEQ ID NO: 19008) |
| 155 | RTCYATGATAARG (SEQ ID NO: 19009) |
| 155 | R + TCYATG + A + TAARG (SEQ ID NO: 19010) |
| 155 | RTCYA + TG + A + TAARG (SEQ ID NO: 19011) |
| 155 | RTCY + ATG + A + TAARG (SEQ ID NO: 19012) |
| 155 | RTCYAT + G + A + TAARG (SEQ ID NO: 19013) |
| 155 | RTCYATG + A + TAAR + G (SEQ ID NO: 19014) |
| 155 | RTCYATG + A + TAARGA (SEQ ID NO: 19015) |
| 155 | RTCYATG + A + TA + ARG (SEQ ID NO: 19016) |
| 155 | GARTCYATGATAARGAAT (SEQ ID NO: 19017) |
| 155 | ARTCYATGATAARGAATT (SEQ ID NO: 19018) |
| 155 | ARTCYATGATAARGAAT (SEQ ID NO: 19019) |
| 155 | RTCYATGATAARGAATT (SEQ ID NO: 19020) |
| 155 | ARTCYATGATAARGA (SEQ ID NO: 19021) |
| 155 | RTCYATGATAARGAA (SEQ ID NO: 19022) |
| 155 | ARTCYATGATAAR (SEQ ID NO: 19023) |
| 155 | RTCYATGATAARG (SEQ ID NO: 19024) |
| 155 | TCTATGCAYAAAGAA (SEQ ID NO: 19025) |
| 155 | TCTATGAGYAAAGAA (SEQ ID NO: 19026) |
| 155 | TCTATGACYAAAGAA (SEQ ID NO: 19027) |
| 163 | AAAATYAT + A + GRCARGTMA (SEQ ID NO: 19028) |
| 163 | AA + AATYATAGRCARGTMA (SEQ ID NO: 19029) |
| 163 | AAA + ATYATAGRCARGTMA (SEQ ID NO: 19030) |
| 163 | AAAATYA + TAGRCARGTMA (SEQ ID NO: 19031) |
| 163 | A + AAATYATAGRCARGTMA (SEQ ID NO: 19032) |
| 163 | AAAATYATAGRCAR + GTMA (SEQ ID NO: 19033) |
| 163 | AAAATYATA + GRCARGTMA (SEQ ID NO: 19034) |
| 163 | AAAATYATAG + RCARGTMA (SEQ ID NO: 19035) |
| 163 | AAAATYATAGRCA + RGTMA (SEQ ID NO: 19036) |
| 163 | AAAA + TYAT + A + GRCARGTMA (SEQ ID NO: 19037) |
| 163 | AA + AATYAT + A + GRCARGTMA (SEQ ID NO: 19038) |
| 163 | AAAAT + YAT + A + GRCARGTMA (SEQ ID NO: 19039) |
| 163 | AAAATY + AT + A + GRCARGTMA (SEQ ID NO: 19040) |
| 163 | AAAATYAT + A + G + RCARGTMA (SEQ ID NO: 19041) |
| 163 | AAAATYAT + A + GRC + ARGTMA (SEQ ID NO: 19042) |

TABLE 13-continued

| | |
|---|---|
| 163 | AAAATYAT + A + GR + CARGTMA (SEQ ID NO: 19043) |
| 163 | AAAATYAT + A + GRCA + RGTMA (SEQ ID NO: 19044) |
| 163 | AAATYAT + A + GRCARGTMA (SEQ ID NO: 19045) |
| 163 | A + AATYATAGRCARGTMA (SEQ ID NO: 19046) |
| 163 | AA + ATYATAGRCARGTMA (SEQ ID NO: 19047) |
| 163 | AAATYA + TAGRCARGTMA (SEQ ID NO: 19048) |
| 163 | +AAATYATAGRCARGTMA (SEQ ID NO: 19049) |
| 163 | AAATYATAGRCAR + GTMA (SEQ ID NO: 19050) |
| 163 | AAATYATA + GRCARGTMA (SEQ ID NO: 19051) |
| 163 | AAATYATAG + RCARGTMA (SEQ ID NO: 19052) |
| 163 | AAATYATAGRCA + RGTMA (SEQ ID NO: 19053) |
| 163 | AAA + TYAT + A + GRCARGTMA (SEQ ID NO: 19054) |
| 163 | A + AATYAT + A + GRCARGTMA (SEQ ID NO: 19055) |
| 163 | AAAT + YAT + A + GRCARGTMA (SEQ ID NO: 19056) |
| 163 | AAATY + AT + A + GRCARGTMA (SEQ ID NO: 19057) |
| 163 | AAATYAT + A + G + RCARGTMA (SEQ ID NO: 19058) |
| 163 | AAATYAT + A + GRC + ARGTMA (SEQ ID NO: 19059) |
| 163 | AAATYAT + A + GR + CARGTMA (SEQ ID NO: 19060) |
| 163 | AAATYAT + A + GRCA + RGTMA (SEQ ID NO: 19061) |
| 163 | AAATYAT + A + GRCARGT (SEQ ID NO: 19062) |
| 163 | A + AATYATAGRCARGT (SEQ ID NO: 19063) |
| 163 | AA + ATYATAGRCARGT (SEQ ID NO: 19064) |
| 163 | AAATYA + TAGRCARGT (SEQ ID NO: 19065) |
| 163 | +AAATYATAGRCARGT (SEQ ID NO: 19066) |
| 163 | AAATYATAGRCAR + GT (SEQ ID NO: 19067) |
| 163 | AAATYATA + GRCARGT (SEQ ID NO: 19068) |
| 163 | AAATYATAG + RCARGT (SEQ ID NO: 19069) |
| 163 | AAATYATAGRCA + RGT (SEQ ID NO: 19070) |
| 163 | AAA + TYAT + A + GRCARGT (SEQ ID NO: 19071) |
| 163 | A + AATYAT + A + GRCARGT (SEQ ID NO: 19072) |
| 163 | AAAT + YAT + A + GRCARGT (SEQ ID NO: 19073) |
| 163 | AAATY + AT + A + GRCARGT (SEQ ID NO: 19074) |
| 163 | AAATYAT + A + G + RCARGT (SEQ ID NO: 19075) |
| 163 | AAATYAT + A + GRC + ARGT (SEQ ID NO: 19076) |
| 163 | AAATYAT + A + GR + CARGT (SEQ ID NO: 19077) |
| 163 | AAATYAT + A + GRCA + RGT (SEQ ID NO: 19078) |
| 163 | AAATYAT + A + GRCAR (SEQ ID NO: 19079) |
| 163 | A + AATYATAGRCAR (SEQ ID NO: 19080) |
| 163 | AA + ATYATAGRCAR (SEQ ID NO: 19081) |
| 163 | AAATYA + TAGRCAR (SEQ ID NO: 19082) |
| 163 | +AAATYATAGRCAR (SEQ ID NO: 19083) |
| 163 | AAATYATAGRCAR (SEQ ID NO: 19084) |
| 163 | AAATYATA + GRCAR (SEQ ID NO: 19085) |
| 163 | AAATYATAG + RCAR (SEQ ID NO: 19086) |
| 163 | AAATYATAGRCA + R (SEQ ID NO: 19087) |
| 163 | AAA + TYAT + A + GRCAR (SEQ ID NO: 19088) |
| 163 | A + AATYAT + A + GRCAR (SEQ ID NO: 19089) |
| 163 | AAAT + YAT + A + GRCAR (SEQ ID NO: 19090) |
| 163 | AAATY + AT + A + GRCAR (SEQ ID NO: 19091) |
| 163 | AAATYAT + A + G + RCAR (SEQ ID NO: 19092) |
| 163 | AAATYAT + A + GRC + AR (SEQ ID NO: 19093) |
| 163 | AAATYAT + A + GR + CAR (SEQ ID NO: 19094) |
| 163 | AAATYAT + A + GRCA + R (SEQ ID NO: 19095) |
| 163 | AAAATYATAGRCARGTMA (SEQ ID NO: 19096) |
| 163 | AAATYATAGRCARGTMA (SEQ ID NO: 19097) |
| 163 | AAATYATAGRCARGT (SEQ ID NO: 19098) |
| 163 | AAATYATAGRCAR (SEQ ID NO: 19099) |
| 163 | ATTATAMGRCAGGTA (SEQ ID NO: 19100) |
| 163 | ATTATAAARCAGGTA (SEQ ID NO: 19101) |
| 230 | TACAGRGA + C + GCAGAGAYC (SEQ ID NO: 19102) |
| 230 | TACAGRGA + CGCAGAGAYC (SEQ ID NO: 19103) |
| 230 | TACAGR + GACGCAGAGAYC (SEQ ID NO: 19104) |
| 230 | TA + CAGRGACGCAGAGAYC (SEQ ID NO: 19105) |
| 230 | T + ACAGRGACGCAGAGAYC (SEQ ID NO: 19106) |
| 230 | TACAGRGAC + GCAGAGAYC (SEQ ID NO: 19107) |
| 230 | TACAGRGACG + CAGAGAYC (SEQ ID NO: 19108) |
| 230 | TACAGRGACGC + AGAGAYC (SEQ ID NO: 19109) |
| 230 | TACAGRGACGCAGAGA + YC (SEQ ID NO: 19110) |
| 230 | TACAGRG + A + C + GCAGAGAYC (SEQ ID NO: 19111) |
| 230 | TACAGR + GA + C + GCAGAGAYC (SEQ ID NO: 19112) |
| 230 | TAC + AGRGA + C + GCAGAGAYC (SEQ ID NO: 19113) |
| 230 | TACAG + RGA + C + GCAGAGAYC (SEQ ID NO: 19114) |

TABLE 13-continued

| | |
|---|---|
| 230 | TACAGRGA + C + GC + AGAGAYC (SEQ ID NO: 19115) |
| 230 | TACAGRGA + C + GCAGAGAY + C (SEQ ID NO: 19116) |
| 230 | TACAGRGA + C + G + CAGAGAYC (SEQ ID NO: 19117) |
| 230 | TACAGRGA + C + GCAGA + GAYC (SEQ ID NO: 19118) |
| 230 | ACAGRGA + C + GCAGAGAYC (SEQ ID NO: 19119) |
| 230 | ACAGRGA + CGCAGAGAYC (SEQ ID NO: 19120) |
| 230 | ACAGR + GACGCAGAGAYC (SEQ ID NO: 19121) |
| 230 | A + CAGRGACGCAGAGAYC (SEQ ID NO: 19122) |
| 230 | +ACAGRGACGCAGAGAYC (SEQ ID NO: 19123) |
| 230 | ACAGRGAC + GCAGAGAYC (SEQ ID NO: 19124) |
| 230 | ACAGRGACG + CAGAGAYC (SEQ ID NO: 19125) |
| 230 | ACAGRGACGC + AGAGAYC (SEQ ID NO: 19126) |
| 230 | ACAGRGACGCAGAGA + YC (SEQ ID NO: 19127) |
| 230 | ACAGRG + A + C + GCAGAGAYC (SEQ ID NO: 19128) |
| 230 | ACAGR + GA + C + GCAGAGAYC (SEQ ID NO: 19129) |
| 230 | AC + AGRGA + C + GCAGAGAYC (SEQ ID NO: 19130) |
| 230 | ACAG + RGA + C + GCAGAGAYC (SEQ ID NO: 19131) |
| 230 | ACAGRGA + C + GC + AGAGAYC (SEQ ID NO: 19132) |
| 230 | ACAGRGA + C + GCAGAGAY + C (SEQ ID NO: 19133) |
| 230 | ACAGRGA + C + G + CAGAGAYC (SEQ ID NO: 19134) |
| 230 | ACAGRGA + C + GCAGA + GAYC (SEQ ID NO: 19135) |
| 230 | ACAGRGA + C + GCAGAGA (SEQ ID NO: 19136) |
| 230 | ACAGRGA + CGCAGAGA (SEQ ID NO: 19137) |
| 230 | ACAGR + GACGCAGAGA (SEQ ID NO: 19138) |
| 230 | A + CAGRGACGCAGAGA (SEQ ID NO: 19139) |
| 230 | +ACAGRGACGCAGAGA (SEQ ID NO: 19140) |
| 230 | ACAGRGAC + GCAGAGA (SEQ ID NO: 19141) |
| 230 | ACAGRGACG + CAGAGA (SEQ ID NO: 19142) |
| 230 | ACAGRGACGC + AGAGA (SEQ ID NO: 19143) |
| 230 | ACAGRGACGCAGAGA (SEQ ID NO: 19144) |
| 230 | ACAGRG + A + C + GCAGAGA (SEQ ID NO: 19145) |
| 230 | ACAGR + GA + C + GCAGAGA (SEQ ID NO: 19146) |
| 230 | AC + AGRGA + C + GCAGAGA (SEQ ID NO: 19147) |
| 230 | ACAG + RGA + C + GCAGAGA (SEQ ID NO: 19148) |
| 230 | ACAGRGA + C + GC + AGAGA (SEQ ID NO: 19149) |
| 230 | ACAGRGA + C + GCAGAGAY (SEQ ID NO: 19150) |
| 230 | ACAGRGA + C + G + CAGAGA (SEQ ID NO: 19151) |
| 230 | ACAGRGA + C + GCAGA + GA (SEQ ID NO: 19152) |
| 230 | ACAGRGA + C + GCAGA (SEQ ID NO: 19153) |
| 230 | ACAGRGA + CGCAGA (SEQ ID NO: 19154) |
| 230 | ACAGR + GACGCAGA (SEQ ID NO: 19155) |
| 230 | A + CAGRGACGCAGA (SEQ ID NO: 19156) |
| 230 | +ACAGRGACGCAGA (SEQ ID NO: 19157) |
| 230 | ACAGRGAC + GCAGA (SEQ ID NO: 19158) |
| 230 | ACAGRGACG + CAGA (SEQ ID NO: 19159) |
| 230 | ACAGRGACGC + AGA (SEQ ID NO: 19160) |
| 230 | ACAGRGACGCAGAG (SEQ ID NO: 19161) |
| 230 | ACAGRG + A + C + GCAGA (SEQ ID NO: 19162) |
| 230 | ACAGR + GA + C + GCAGA (SEQ ID NO: 19163) |
| 230 | AC + AGRGA + C + GCAGA (SEQ ID NO: 19164) |
| 230 | ACAG + RGA + C + GCAGA (SEQ ID NO: 19165) |
| 230 | ACAGRGA + C + GC + AGA (SEQ ID NO: 19166) |
| 230 | ACAGRGA + C + GCAGAG (SEQ ID NO: 19167) |
| 230 | ACAGRGA + C + G + CAGA (SEQ ID NO: 19168) |
| 230 | ACAGRGA + C + GCAGA (SEQ ID NO: 19169) |
| 230 | TACAGRGACGCAGAGAYC (SEQ ID NO: 19170) |
| 230 | ACAGRGACGCAGAGAYC (SEQ ID NO: 19171) |
| 230 | ACAGRGACGCAGAGA (SEQ ID NO: 19172) |
| 230 | ACAGRGACGCAGAGAY (SEQ ID NO: 19173) |
| 230 | ACAGRGACGCAGA (SEQ ID NO: 19174) |
| 230 | AGGGACCGCAGAGAC (SEQ ID NO: 19175) |
| 263 | TRCCAAGR + A + RAAAGYAAA (SEQ ID NO: 19176) |
| 263 | TRCCAAG + RARAAAGYAAA (SEQ ID NO: 19177) |
| 263 | TRCCAA + GRARAAAGYAAA (SEQ ID NO: 19178) |
| 263 | TR + CCAAGRARAAAGYAAA (SEQ ID NO: 19179) |
| 263 | TRC + CAAGRARAAAGYAAA (SEQ ID NO: 19180) |
| 263 | TRCCAAGRARAAA + GYAAA (SEQ ID NO: 19181) |
| 263 | TRCCAAGRARAAAGY + AAA (SEQ ID NO: 19182) |
| 263 | TRCCAAGRARAA + AGYAAA (SEQ ID NO: 19183) |
| 263 | TRCCAAGRAR + AAAGYAAA (SEQ ID NO: 19184) |
| 263 | TR + CCAAGR + A + RAAAGYAAA (SEQ ID NO: 19185) |
| 263 | TRC + CAAGR + A + RAAAGYAAA (SEQ ID NO: 19186) |

TABLE 13-continued

| | |
|---|---|
| 263 | TRCCAA + GR + A + RAAAGYAAA (SEQ ID NO: 19187) |
| 263 | TRCCAAG + R + A + RAAAGYAAA (SEQ ID NO: 19188) |
| 263 | TRCCAAGR + A + RAAAG + YAAA (SEQ ID NO: 19189) |
| 263 | TRCCAAGR + A + RAA + AGYAAA (SEQ ID NO: 19190) |
| 263 | TRCCAAGR + A + RAAA + GYAAA (SEQ ID NO: 19191) |
| 263 | TRCCAAGR + A + R + AAAGYAAA (SEQ ID NO: 19192) |
| 263 | RCCAAGR + A + RAAAGYAAA (SEQ ID NO: 19193) |
| 263 | RCCAAG + RARAAAGYAAA (SEQ ID NO: 19194) |
| 263 | RCCAA + GRARAAAGYAAA (SEQ ID NO: 19195) |
| 263 | R + CCAAGRARAAAGYAAA (SEQ ID NO: 19196) |
| 263 | RC + CAAGRARAAAGYAAA (SEQ ID NO: 19197) |
| 263 | RCCAAGRARAAA + GYAAA (SEQ ID NO: 19198) |
| 263 | RCCAAGRARAAAGY + AAA (SEQ ID NO: 19199) |
| 263 | RCCAAGRARAAA + AGYAAA (SEQ ID NO: 19200) |
| 263 | RCCAAGRAR + AAAGYAAA (SEQ ID NO: 19201) |
| 263 | R + CCAAGR + A + RAAAGYAAA (SEQ ID NO: 19202) |
| 263 | RC + CAAGR + A + RAAAGYAAA (SEQ ID NO: 19203) |
| 263 | RCCAA + GR + A + RAAAGYAAA (SEQ ID NO: 19204) |
| 263 | RCCAAG + R + A + RAAAGYAAA (SEQ ID NO: 19205) |
| 263 | RCCAAGR + A + RAAAG + YAAA (SEQ ID NO: 19206) |
| 263 | RCCAAGR + A + RAA + AGYAAA (SEQ ID NO: 19207) |
| 263 | RCCAAGR + A + RAAA + GYAAA (SEQ ID NO: 19208) |
| 263 | RCCAAGR + A + R + AAAGYAAA (SEQ ID NO: 19209) |
| 263 | RCCAAGR + A + RAAAGYA (SEQ ID NO: 19210) |
| 263 | RCCAAG + RARAAAGYA (SEQ ID NO: 19211) |
| 263 | RCCAA + GRARAAAGYA (SEQ ID NO: 19212) |
| 263 | R + CCAAGRARAAAGYA (SEQ ID NO: 19213) |
| 263 | RC + CAAGRARAAAGYA (SEQ ID NO: 19214) |
| 263 | RCCAAGRARAAA + GYA (SEQ ID NO: 19215) |
| 263 | RCCAAGRARAAAGY + A (SEQ ID NO: 19216) |
| 263 | RCCAAGRARAAA + AGYA (SEQ ID NO: 19217) |
| 263 | RCCAAGRAR + AAAGYA (SEQ ID NO: 19218) |
| 263 | R + CCAAGR + A + RAAAGYA (SEQ ID NO: 19219) |
| 263 | RC + CAAGR + A + RAAAGYA (SEQ ID NO: 19220) |
| 263 | RCCAA + GR + A + RAAAGYA (SEQ ID NO: 19221) |
| 263 | RCCAAG + R + A + RAAAGYA (SEQ ID NO: 19222) |
| 263 | RCCAAGR + A + RAAAG + YA (SEQ ID NO: 19223) |
| 263 | RCCAAGR + A + RAA + AGYA (SEQ ID NO: 19224) |
| 263 | RCCAAGR + A + RAAA + GYA (SEQ ID NO: 19225) |
| 263 | RCCAAGR + A + R + AAAGYA (SEQ ID NO: 19226) |
| 263 | RCCAAGR + A + RAAAG (SEQ ID NO: 19227) |
| 263 | RCCAAG + RARAAAG (SEQ ID NO: 19228) |
| 263 | RCCAA + GRARAAAG (SEQ ID NO: 19229) |
| 263 | R + CCAAGRARAAAG (SEQ ID NO: 19230) |
| 263 | RC + CAAGRARAAAG (SEQ ID NO: 19231) |
| 263 | RCCAAGRARAAA + G (SEQ ID NO: 19232) |
| 263 | RCCAAGRARAAAGY (SEQ ID NO: 19233) |
| 263 | RCCAAGRARAA + AG (SEQ ID NO: 19234) |
| 263 | RCCAAGRAR + AAAG (SEQ ID NO: 19235) |
| 263 | R + CCAAGR + A + RAAAG (SEQ ID NO: 19236) |
| 263 | RC + CAAGR + A + RAAAG (SEQ ID NO: 19237) |
| 263 | RCCAA + GR + A + RAAAG (SEQ ID NO: 19238) |
| 263 | RCCAAG + R + A + RAAAG (SEQ ID NO: 19239) |
| 263 | RCCAAGR + A + RAAAG (SEQ ID NO: 19240) |
| 263 | RCCAAGR + A + RAA + AG (SEQ ID NO: 19241) |
| 263 | RCCAAGR + A + RAAA + G (SEQ ID NO: 19242) |
| 263 | RCCAAGR + A + R + AAAG (SEQ ID NO: 19243) |
| 263 | TRCCAAGRARAAAGYAAA (SEQ ID NO: 19244) |
| 263 | RCCAAGRARAAAGYAAA (SEQ ID NO: 19245) |
| 263 | RCCAAGRARAAAGYA (SEQ ID NO: 19246) |
| 263 | RCCAAGRARAAAG (SEQ ID NO: 19247) |
| 263 | CCAAGAARAAAGCA (SEQ ID NO: 19248) |

Other embodiments will be evident to those of skill in the art. It should be understood that the foregoing description is provided for clarity only and is merely exemplary. The spirit and scope of the present invention are not limited to the above examples, but are encompassed by the following claims. All publications and patent applications cited above are incorporated by reference herein in their entirety for all purposes to the same extent as if each individual publication or patent application were specifically indicated to be so incorporated by reference.

LENGTHY TABLES

The patent contains a lengthy table section. A copy of the table is available in electronic form from the USPTO web site (http://seqdata.uspto.gov/?pageRequest=docDetail&DocID=US10100349B2). An electronic copy of the table will also be available from the USPTO upon request and payment of the fee set forth in 37 CFR 1.19(b)(3).

SEQUENCE LISTING (19331 sequences)

SEQ ID NO: 1 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 40 to correspond to the nucleotides in an oligonucleotide probe upstream of the discriminating single nucleotide polymorphism.
ccattracagaagaraaaataaaagcmttaryagmmatytgtaca

SEQ ID NO: 2 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 40 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ccattracagaagaraaaataaaagcmttaryagmmatytgtacan

SEQ ID NO: 3 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 41 to correspond to the nucleotides in an oligonucleotide probe upstream of the discriminating single nucleotide polymorphism.
aaaataaaagcattaryagmmatttgtrmdgad

SEQ ID NO: 4 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 41 to correspond to the nucleotides in an oligonucleotide probe upstream of the discriminating single nucleotide polymorphism.
araaaataaaagcattaryagmmatttgtrmdgad

SEQ ID NO: 5 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 41 to correspond to the nucleotides in an oligonucleotide probe upstream of the discriminating single nucleotide polymorphism.
agaagaraaaataaaagcattaryagmmatttgtrmdgad

SEQ ID NO: 6 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 41 to correspond to the nucleotides in an oligonucleotide probe upstream of the discriminating single nucleotide polymorphism.
gcattaryagmmatttgtrmdgad

SEQ ID NO: 7 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 41 to correspond to the nucleotides in an oligonucleotide probe upstream of the discriminating single nucleotide polymorphism.
taaaagcattaryagmmatttgtrmdgad

SEQ ID NO: 8 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 41 to correspond to the nucleotides in an oligonucleotide probe upstream of the discriminating single nucleotide polymorphism.
aaataaaagcattaryagmmatttgtrmdgad

SEQ ID NO: 9 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 41 to correspond to the nucleotides in an oligonucleotide probe upstream of the discriminating single nucleotide polymorphism.
ttracagaagaraaaataaaagcmttaryagmmatytgtacagaa

SEQ ID NO: 10 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 41 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
aaaataaaagcattaryagmmatttgtrmdgadn

SEQ ID NO: 11 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 41 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
araaaataaaagcattaryagmmatttgtrmdgadn

SEQ ID NO: 12 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 41 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
agaagaraaaataaaagcattaryagmmatttgtrmdgadn

SEQ ID NO: 13 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 41 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
gcattaryagmmatttgtrmdgadn

SEQ ID NO: 14 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 41 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
taaaagcattaryagmmatttgtrmdgadn

SEQ ID NO: 15 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 41 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
aaataaaagcattaryagmmatttgtrmdgadn

SEQ ID NO: 16 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 41 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ttracagaagaraaaataaaagcmttaryagmmatytgtacagaan

SEQ ID NO: 17 - DNA, 33 bp, Artificial Sequence; identical to SEQ ID NO: 3
  Pan degenerate oligonucleotide primer
  primer_bind (1)..(33)
  modified_base (1)..(1): base is a locked nucleic acid
  modified_base (2)..(2): base is a locked nucleic acid
  modified_base (10)..(10): base is a locked nucleic acid
  misc_feature (27)..(33): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 18 - DNA, 33 bp, Artificial Sequence; identical to SEQ ID NO: 3
  Pan degenerate oligonucleotide primer
  primer_bind (1)..(33)
  modified_base (1)..(1): base is a locked nucleic acid
  modified_base (5)..(5): base is a locked nucleic acid
  modified_base (10)..(10): base is a locked nucleic acid
  misc_feature (27)..(33): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 19 - DNA, 33 bp, Artificial Sequence; identical to SEQ ID NO: 3
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 20 - DNA, 35 bp, Artificial Sequence; identical to SEQ ID NO: 4
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 21 - DNA, 35 bp, Artificial Sequence; identical to SEQ ID NO: 4
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 22 - DNA, 35 bp, Artificial Sequence; identical to SEQ ID NO: 4
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 23 - DNA, 40 bp, Artificial Sequence; identical to SEQ ID NO: 5
  Pan degenerate oligonucleotide primer
  primer_bind (1)..(40)
  modified_base (5)..(5): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 24 - DNA, 40 bp, Artificial Sequence; identical to SEQ ID NO: 5
  Pan degenerate oligonucleotide primer
  primer_bind (1)..(40)
  modified_base (5)..(5): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 25 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (13)..(13): base is a locked nucleic acid
  misc_feature (18)..(24): Adaptor region of the pan degenerate sense primer that adapts the probe-binding site upstream of codon 41 to correspond to the nucleotides in an oligonucleotide probe upstream of the discriminating single nucleotide polymorphism.
gcattaryagmmatttgtrmdgad

SEQ ID NO: 26 - DNA, 24 bp, Artificial Sequence
  Pan degenerate oligonucleotide primer
  primer_bind (1)..(24)
  modified_base (1)..(1): base is a locked nucleic acid
  modified_base (5)..(5): base is a locked nucleic acid
  modified_base (13)..(13): base is a locked nucleic acid
  misc_feature (18)..(24): Adaptor region of the pan degenerate sense primer that adapts the probe-binding site upstream of codon 41 to correspond to the nucleotides in an oligonucleotide probe upstream of the discriminating single nucleotide polymorphism.
gcattaryagmmatttgtrmdgad

SEQ ID NO: 27 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (5)..(5): base is a locked nucleic acid
  misc_feature (18)..(24): Adaptor region of the pan degenerate sense primer that adapts the probe-binding site upstream of codon 41 to correspond to the nucleotides in an oligonucleotide probe upstream of the discriminating single nucleotide polymorphism.
gcattaryagmmatttgtrmdgad

SEQ ID NO: 28 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (10)..(10): base is a locked nucleic acid
  misc_feature (23)..(29): Adaptor region of the pan degenerate sense primer that adapts the probe-binding site upstream of codon 41 to correspond to the nucleotides in an oligonucleotide probe upstream of the discriminating single nucleotide polymorphism.
taaaagcattaryagmmatttgtrmdgad

SEQ ID NO: 29 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (10)..(10): base is a locked nucleic acid
  misc_feature (23)..(29): Adaptor region of the pan degenerate sense primer that adapts the probe-binding site upstream of codon 41 to correspond to the nucleotides in an oligonucleotide probe upstream of the discriminating single nucleotide polymorphism.
taaaagcattaryagmmatttgtrmdgad

SEQ ID NO: 30 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate sense primer that adapts the probe-binding site upstream of codon 41 to correspond to the nucleotides in an oligonucleotide probe upstream of the discriminating single nucleotide polymorphism.
taaaagcattaryagmmatttgtrmdgad

SEQ ID NO: 31 - DNA, 32 bp, Artificial Sequence; identical to SEQ ID NO: 8
  Pan degenerate oligonucleotide primer
  primer_bind (1)..(32)
  modified_base (1)..(1): base is a locked nucleic acid
  modified_base (4)..(4): base is a locked nucleic acid
  modified_base (10)..(10): base is a locked nucleic acid
  misc_feature (26)..(32): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 32 - DNA, 32 bp, Artificial Sequence; identical to SEQ ID NO: 8
  Pan degenerate oligonucleotide primer
  primer_bind (1)..(32)
  modified_base (1)..(1): base is a locked nucleic acid
  modified_base (9)..(9): base is a locked nucleic acid
  modified_base (10)..(10): base is a locked nucleic acid
  misc_feature (26)..(32): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 33 - DNA, 32 bp, Artificial Sequence; identical to SEQ ID NO: 8
  Pan degenerate oligonucleotide primer
  primer_bind (1)..(32)
  modified_base (1)..(1): base is a locked nucleic acid
  modified_base (4)..(4): base is a locked nucleic acid
  modified_base (9)..(9): base is a locked nucleic acid
  misc_feature (26)..(32): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 34 - DNA, 40 bp, Artificial Sequence; identical to SEQ ID NO: 5
  Pan degenerate oligonucleotide primer
  primer_bind (1)..(40)
  modified_base (5)..(5): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 41 to correspond to the nucleotides in an oligonucleotide probe upstream of the discriminating single nucleotide polymorphism.

SEQ ID NO: 35 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.
cattaryagmmatttgtrmdgadatggarrarga

SEQ ID NO: 36 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 44 to correspond to the nucleotides in an oligonucleotide probe upstream of the discriminating single nucleotide polymorphism.
cattaryagmmatttgtrmdgadatggarrarg

SEQ ID NO: 37 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 44 to correspond to the nucleotides in an oligonucleotide probe upstream of the discriminating single nucleotide polymorphism.
gcattaryagmmatttgtrmdgadatggarrarga

SEQ ID NO: 38 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.
gcattaryagmmatttgtrmdgadatggarrarg

SEQ ID NO: 39 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.
taaaagcattaryagmmatttgtrmdgadatggarrarga

SEQ ID NO: 40 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.
ataaaagcattaryagmmatttgtrmdgadatggarrarg

SEQ ID NO: 41 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarga

SEQ ID NO: 42 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarg

SEQ ID NO: 43 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarga

SEQ ID NO: 44 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarg

SEQ ID NO: 45 - DNA, 31 bp, Artificial Sequence
  Pan degenerate oligonucleotide primer
  primer_bind (1)..(31)
  misc_feature (25)..(31): Adaptor region of the pan degenerate sense primer that adapts the probe-binding site upstream of codon 44 to correspond to the nucleotides in an oligonucleotide probe upstream of the discriminating single nucleotide polymorphism.
taryagmmatttgtrmdgadatggarrarga

SEQ ID NO: 46 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 44 to correspond to the nucleotides in an oligonucleotide probe upstream of the discriminating single nucleotide polymorphism.
taryagmmatttgtrmdgadatggarrarg

SEQ ID NO: 47 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 44 to correspond to the nucleotides in an oligonucleotide probe upstream of the discriminating single nucleotide polymorphism.
garaaaataaaagcmttaryagmmatytgtrmdgaratggaaaag

SEQ ID NO: 48 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
cattaryagmmatttgtrmdgadatggarrargan

SEQ ID NO: 49 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 44 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cattaryagmmatttgtrmdgadatggarrargn

SEQ ID NO: 50 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 44 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
gcattaryagmmatttgtrmdgadatggarrargan

SEQ ID NO: 51 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
gcattaryagmmatttgtrmdgadatggarrargn

SEQ ID NO: 52 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
taaaagcattaryagmmatttgtrmdgadatggarrargan

SEQ ID NO: 53 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ataaaagcattaryagmmatttgtrmdgadatggarrargn

SEQ ID NO: 54 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
tttgtrmdgadatggarrargan

SEQ ID NO: 55 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 44 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
tttgtrmdgadatggarrargn

SEQ ID NO: 56 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 44 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
atttgtrmdgadatggarrargan

SEQ ID NO: 57 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
atttgtrmdgadatggarrargn

SEQ ID NO: 58 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 44 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
taryagmmatttgtrmdgadatggarrargan

SEQ ID NO: 59 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 44 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
taryagmmatttgtrmdgadatggarrargn

SEQ ID NO: 60 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 44 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
garaaaataaaagcmttaryagmmatytgtrmdgaratggaaaagn

SEQ ID NO: 61 - DNA, 34 bp, Artificial Sequence; identical to SEQ ID NO: 35
  Pan degenerate oligonucleotide primer
  primer_bind (1)..(34)
  modified_base (1)..(1): base is a locked nucleic acid
  modified_base (4)..(4): base is a locked nucleic acid
  modified_base (13)..(13): base is a locked nucleic acid
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 62 - DNA, 33 bp, Artificial Sequence; identical to SEQ ID NO: 36
  Pan degenerate oligonucleotide primer
  primer_bind (1)..(33)
  modified_base (1)..(1): base is a locked nucleic acid
  modified_base (4)..(4): base is a locked nucleic acid
  modified_base (13)..(13): base is a locked nucleic acid
  misc_feature (27)..(33): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 63 - DNA, 34 bp, Artificial Sequence; identical to SEQ ID NO: 35
  Pan degenerate oligonucleotide primer
  primer_bind (1)..(34)
  modified_base (1)..(1): base is a locked nucleic acid
  modified_base (12)..(12): base is a locked nucleic acid
  modified_base (13)..(13): base is a locked nucleic acid
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 64 - DNA, 33 bp, Artificial Sequence; identical to SEQ ID NO: 36
  Pan degenerate oligonucleotide primer
  primer_bind (1)..(33)
  modified_base (1)..(1): base is a locked nucleic acid
  modified_base (12)..(12): base is a locked nucleic acid
  modified_base (13)..(13): base is a locked nucleic acid
  misc_feature (27)..(33): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 65 - DNA, 34 bp, Artificial Sequence; identical to SEQ ID NO: 35
  Pan degenerate oligonucleotide primer
  primer_bind (1)..(34)
  modified_base (1)..(1): base is a locked nucleic acid
  modified_base (4)..(4): base is a locked nucleic acid
  modified_base (12)..(12): base is a locked nucleic acid
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 66 - DNA, 33 bp, Artificial Sequence; identical to SEQ ID NO: 36
  Pan degenerate oligonucleotide primer
  primer_bind (1)..(33)
  modified_base (1)..(1): base is a locked nucleic acid
  modified_base (4)..(4): base is a locked nucleic acid
  modified_base (12)..(12): base is a locked nucleic acid
  misc_feature (27)..(33): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 67 - DNA, 35 bp, Artificial Sequence; identical to SEQ ID NO: 37
  Pan degenerate oligonucleotide primer
  primer_bind (1)..(35)
  modified_base (1)..(1): base is a locked nucleic acid
  modified_base (2)..(2): base is a locked nucleic acid
  modified_base (13)..(13): base is a locked nucleic acid
  misc_feature (29)..(35): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 68 - DNA, 34 bp, Artificial Sequence; identical to SEQ ID NO: 38
  Pan degenerate oligonucleotide primer
  primer_bind (1)..(34)
  modified_base (1)..(1): base is a locked nucleic acid
  modified_base (2)..(2): base is a locked nucleic acid
  modified_base (13)..(13): base is a locked nucleic acid
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 69 - DNA, 35 bp, Artificial Sequence; identical to SEQ ID NO: 37
  Pan degenerate oligonucleotide primer
  primer_bind (1)..(35)
  modified_base (1)..(1): base is a locked nucleic acid
  modified_base (5)..(5): base is a locked nucleic acid
  modified_base (13)..(13): base is a locked nucleic acid
  misc_feature (29)..(35): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 70 - DNA, 34 bp, Artificial Sequence; identical to SEQ ID NO: 38
  Pan degenerate oligonucleotide primer
  primer_bind (1)..(34)
  modified_base (1)..(1): base is a locked nucleic acid
  modified_base (5)..(5): base is a locked nucleic acid
  modified_base (13)..(13): base is a locked nucleic acid
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 71 - DNA, 35 bp, Artificial Sequence; identical to SEQ ID NO: 37
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 72 - DNA, 34 bp, Artificial Sequence; identical to SEQ ID NO: 38
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 73 - DNA, 40 bp, Artificial Sequence; identical to SEQ ID NO: 39
  Pan degenerate oligonucleotide primer
  primer_bind (1)..(40)
  modified_base (1)..(1): base is a locked nucleic acid
  modified_base (6)..(6): base is a locked nucleic acid
  modified_base (10)..(10): base is a locked nucleic acid
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 74 - DNA, 40 bp, Artificial Sequence; identical to SEQ ID NO: 40
  Pan degenerate oligonucleotide primer
  primer_bind (1)..(40)
  modified_base (2)..(2): base is a locked nucleic acid
  modified_base (7)..(7): base is a locked nucleic acid
  modified_base (11)..(11): base is a locked nucleic acid
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 75 - DNA, 40 bp, Artificial Sequence; identical to SEQ ID NO: 39
  Pan degenerate oligonucleotide primer
  primer_bind (1)..(40)
  modified_base (1)..(1): base is a locked nucleic acid
  modified_base (7)..(7): base is a locked nucleic acid
  modified_base (10)..(10): base is a locked nucleic acid
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 76 - DNA, 40 bp, Artificial Sequence; identical to SEQ ID NO: 40
  Pan degenerate oligonucleotide primer
  primer_bind (1)..(40)
  modified_base (2)..(2): base is a locked nucleic acid
  modified_base (8)..(8): base is a locked nucleic acid
  modified_base (11)..(11): base is a locked nucleic acid
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 77 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (13)..(13): base is a locked nucleic acid
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarga

SEQ ID NO: 78 - DNA, 21 bp, Artificial Sequence
  Pan degenerate oligonucleotide primer
  primer_bind (1)..(21)
  modified_base (1)..(1): base is a locked nucleic acid
  modified_base (3)..(3): base is a locked nucleic acid
  modified_base (13)..(13): base is a locked nucleic acid
  misc_feature (15)..(21): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarg

SEQ ID NO: 79 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (13)..(13): base is a locked nucleic acid
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarga

SEQ ID NO: 80 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (13)..(13): base is a locked nucleic acid
  misc_feature (15)..(21): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarg

SEQ ID NO: 81 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (4)..(4): base is a locked nucleic acid
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarga

SEQ ID NO: 82 - DNA, 21 bp, Artificial Sequence
  Pan degenerate oligonucleotide primer
  primer_bind (1)..(21)
  modified_base (1)..(1): base is a locked nucleic acid
  modified_base (3)..(3): base is a locked nucleic acid
  modified_base (4)..(4): base is a locked nucleic acid
  misc_feature (15)..(21): Adaptor region of the pan degenerate sense primer that adapts the probe-binding site upstream of codon 44 to correspond to the nucleotides in an oligonucleotide probe upstream of the discriminating single nucleotide polymorphism.
tttgtrmdgadatggarrarg

SEQ ID NO: 83 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (5)..(5): base is a locked nucleic acid
  misc_feature (17)..(23): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarga

SEQ ID NO: 84 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (5)..(5): base is a locked nucleic acid
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarg

SEQ ID NO: 85 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (5)..(5): base is a locked nucleic acid
  misc_feature (17)..(23): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarga

SEQ ID NO: 86 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (5)..(5): base is a locked nucleic acid
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarg

SEQ ID NO: 87 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (4)..(4): base is a locked nucleic acid
  misc_feature (17)..(23): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarga

SEQ ID NO: 88 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (4)..(4): base is a locked nucleic acid
  misc_feature (16)..(22): Adaptor region of the pan degenerate sense primer that adapts the probe-binding site upstream of codon 44 to correspond to the nucleotides in an oligonucleotide probe upstream of the discriminating single nucleotide polymorphism.
atttgtrmdgadatggarrarg

SEQ ID NO: 89 - DNA, 31 bp, Artificial Sequence; identical to SEQ ID NO: 45
  Pan degenerate oligonucleotide primer
  primer_bind (1)..(31)
  modified_base (1)..(1): base is a locked nucleic acid
  modified_base (9)..(9): base is a locked nucleic acid
  modified_base (12)..(12): base is a locked nucleic acid
  misc_feature (25)..(31): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 90 - DNA, 30 bp, Artificial Sequence; identical to SEQ ID NO: 46
  Pan degenerate oligonucleotide primer
  primer_bind (1)..(30)
  modified_base (1)..(1): base is a locked nucleic acid
  modified_base (9)..(9): base is a locked nucleic acid
  modified_base (12)..(12): base is a locked nucleic acid
  misc_feature (24)..(30): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 91 - DNA, 31 bp, Artificial Sequence; identical to SEQ ID NO: 45
  Pan degenerate oligonucleotide primer
  primer_bind (1)..(31)
  modified_base (1)..(1): base is a locked nucleic acid
  modified_base (10)..(10): base is a locked nucleic acid
  modified_base (12)..(12): base is a locked nucleic acid
  misc_feature (25)..(31): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 92 - DNA, 30 bp, Artificial Sequence; identical to SEQ ID NO: 46
  Pan degenerate oligonucleotide primer
  primer_bind (1)..(30)
  modified_base (1)..(1): base is a locked nucleic acid
  modified_base (10)..(10): base is a locked nucleic acid
  modified_base (12)..(12): base is a locked nucleic acid
  misc_feature (24)..(30): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 93 - DNA, 31 bp, Artificial Sequence; identical to SEQ ID NO: 45
  Pan degenerate oligonucleotide primer
  primer_bind (1)..(31)
  modified_base (1)..(1): base is a locked nucleic acid
  modified_base (9)..(9): base is a locked nucleic acid
  modified_base (10)..(10): base is a locked nucleic acid
  misc_feature (25)..(31): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 94 - DNA, 30 bp, Artificial Sequence; identical to SEQ ID NO: 46
  Pan degenerate oligonucleotide primer
  primer_bind (1)..(30)
  modified_base (1)..(1): base is a locked nucleic acid
  modified_base (9)..(9): base is a locked nucleic acid
  modified_base (10)..(10): base is a locked nucleic acid
  misc_feature (24)..(30): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 95 - DNA, 40 bp, Artificial Sequence; identical to SEQ ID NO: 39
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 96 - DNA, 40 bp, Artificial Sequence; identical to SEQ ID NO: 40
  Pan degenerate oligonucleotide primer
  primer_bind (1)..(40)
  modified_base (2)..(2): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 44 to correspond to the nucleotides in an oligonucleotide probe upstream of the discriminating single nucleotide polymorphism.

SEQ ID NO: 97 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 62 to correspond to the nucleotides in an oligonucleotide probe upstream of the discriminating single nucleotide polymorphism.
gggcctgaaaayccatayaayactccartatttg

SEQ ID NO: 98 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 62 to correspond to the nucleotides in an oligonucleotide probe upstream of the discriminating single nucleotide polymorphism.
ttgggcctgaaaayccatayaayactccartatttg

SEQ ID NO: 99 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 62 to correspond to the nucleotides in an oligonucleotide probe upstream of the discriminating single nucleotide polymorphism.
araattgggcctgaaaayccatayaayactccartatttg

SEQ ID NO: 100 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 62 to correspond to the nucleotides in an oligonucleotide probe upstream of the discriminating single nucleotide polymorphism.
ctgaaaayccatayaayactccartatttg

SEQ ID NO: 101 - DNA, 31 bp, Artificial Sequence
  Pan degenerate oligonucleotide primer
  primer_bind (1)..(31)
  misc_feature (25)..(31): Adaptor region of the pan degenerate sense primer that adapts the probe-binding site upstream of codon 62 to correspond to the nucleotides in an oligonucleotide probe upstream of the discriminating single nucleotide polymorphism.
cctgaaaayccatayaayactccartatttg

SEQ ID NO: 102 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 62 to correspond to the nucleotides in an oligonucleotide probe upstream of the discriminating single nucleotide polymorphism.
ggcctgaaaayccatayaayactccartatttg

SEQ ID NO: 103 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 62 to correspond to the nucleotides in an oligonucleotide probe upstream of the discriminating single nucleotide polymorphism.
atywcaaraatygggcctgaraayccatayaayactccagtattt

SEQ ID NO: 104 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 62 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
gggcctgaaaayccatayaayactccartatttgn

SEQ ID NO: 105 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 62 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ttgggcctgaaaayccatayaayactccartatttgn

SEQ ID NO: 106 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 62 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
araattgggcctgaaaayccatayaayactccartatttgn

SEQ ID NO: 107 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 62 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
ctgaaaayccatayaayactccartatttgn

SEQ ID NO: 108 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 62 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
cctgaaaayccatayaayactccartatttgn

SEQ ID NO: 109 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 62 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ggcctgaaaayccatayaayactccartatttgn

SEQ ID NO: 110 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 62 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
atywcaaraatygggcctgaraayccatayaayactccagtatttn

SEQ ID NO: 111 - DNA, 34 bp, Artificial Sequence; identical to SEQ ID NO: 97
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 112 - DNA, 34 bp, Artificial Sequence; identical to SEQ ID NO: 97
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 113 - DNA, 34 bp, Artificial Sequence; identical to SEQ ID NO: 97
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 114 - DNA, 36 bp, Artificial Sequence; identical to SEQ ID NO: 98
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 115 - DNA, 36 bp, Artificial Sequence; identical to SEQ ID NO: 98
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 116 - DNA, 36 bp, Artificial Sequence; identical to SEQ ID NO: 98
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 117 - DNA, 40 bp, Artificial Sequence; identical to SEQ ID NO: 99
  Pan degenerate oligonucleotide primer
  primer_bind (1)..(40)
  modified_base (1)..(1): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 118 - DNA, 40 bp, Artificial Sequence; identical to SEQ ID NO: 99
  Pan degenerate oligonucleotide primer
  primer_bind (1)..(40)
  modified_base (1)..(1): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 119 - DNA, 30 bp, Artificial Sequence; identical to SEQ ID NO: 100
  Pan degenerate oligonucleotide primer
  primer_bind (1)..(30)
  modified_base (1)..(1): base is a locked nucleic acid
  modified_base (3)..(3): base is a locked nucleic acid
  modified_base (6)..(6): base is a locked nucleic acid
  misc_feature (24)..(30): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 120 - DNA, 30 bp, Artificial Sequence; identical to SEQ ID NO: 100
  Pan degenerate oligonucleotide primer
  primer_bind (1)..(30)
  modified_base (1)..(1): base is a locked nucleic acid
  modified_base (4)..(4): base is a locked nucleic acid
  modified_base (6)..(6): base is a locked nucleic acid
  misc_feature (24)..(30): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 121 - DNA, 30 bp, Artificial Sequence; identical to SEQ ID NO: 100
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 122 - DNA, 31 bp, Artificial Sequence; identical to SEQ ID NO: 101
  Pan degenerate oligonucleotide primer
  primer_bind (1)..(31)
  modified_base (1)..(1): base is a locked nucleic acid
  modified_base (2)..(2): base is a locked nucleic acid
  modified_base (5)..(5): base is a locked nucleic acid
  misc_feature (25)..(31): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 123 - DNA, 31 bp, Artificial Sequence; identical to SEQ ID NO: 101
  Pan degenerate oligonucleotide primer
  primer_bind (1)..(31)
  modified_base (1)..(1): base is a locked nucleic acid
  modified_base (4)..(4): base is a locked nucleic acid
  modified_base (5)..(5): base is a locked nucleic acid
  misc_feature (25)..(31): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 124 - DNA, 31 bp, Artificial Sequence; identical to SEQ ID NO: 101
  Pan degenerate oligonucleotide primer
  primer_bind (1)..(31)
  modified_base (1)..(1): base is a locked nucleic acid
  modified_base (2)..(2): base is a locked nucleic acid
  modified_base (4)..(4): base is a locked nucleic acid
  misc_feature (25)..(31): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 125 - DNA, 33 bp, Artificial Sequence; identical to SEQ ID NO: 102
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 126 - DNA, 33 bp, Artificial Sequence; identical to SEQ ID NO: 102
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 127 - DNA, 33 bp, Artificial Sequence; identical to SEQ ID NO: 102
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 128 - DNA, 40 bp, Artificial Sequence; identical to SEQ ID NO: 99
  Pan degenerate oligonucleotide primer
  primer_bind (1)..(40)
  modified_base (1)..(1): base is a locked nucleic acid
  modified_base (5)..(5): base is a locked nucleic acid
  modified_base (7)..(7): base is a locked nucleic acid
  misc_feature (34)..(40): Adaptor region of the pan degenerate sense primer that adapts the probe-binding site upstream of codon 62 to correspond to the nucleotides in an oligonucleotide probe upstream of the discriminating single nucleotide polymorphism.

SEQ ID NO: 129 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.
gaaaayccatayaayactccartatttgcyataaara

SEQ ID NO: 130 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.
aaaayccatayaayactccartatttgcyataaaraa

SEQ ID NO: 131 - DNA, 39 bp, Artificial Sequence
  Pan degenerate oligonucleotide primer
  primer_bind (1)..(39)
  misc_feature (33)..(39): Adaptor region of the pan degenerate sense primer that adapts the probe-binding site upstream of codon 65 to correspond to the nucleotides in an oligonucleotide probe upstream of the discriminating single nucleotide polymorphism.
ctgaaaayccatayaayactccartatttgcyataaara

SEQ ID NO: 132 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 65 to correspond to the nucleotides in an oligonucleotide probe upstream of the discriminating single nucleotide polymorphism.
gaaaayccatayaayactccartatttgcyataaaraa

SEQ ID NO: 133 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.
cctgaaaayccatayaayactccartatttgcyataaara

SEQ ID NO: 134 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.
ctgaaaayccatayaayactccartatttgcyataaaraa

SEQ ID NO: 135 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 65 to correspond to the nucleotides in an oligonucleotide probe upstream of the discriminating single nucleotide polymorphism.
ayccatayaayactccartatttgcyataaara

SEQ ID NO: 136 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 65 to correspond to the nucleotides in an oligonucleotide probe upstream of the discriminating single nucleotide polymorphism.
ccatayaayactccartatttgcyataaaraa

SEQ ID NO: 137 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.
aayccatayaayactccartatttgcyataaara

SEQ ID NO: 138 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.
ayccatayaayactccartatttgcyataaaraa

SEQ ID NO: 139 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 65 to correspond to the nucleotides in an oligonucleotide probe upstream of the discriminating single nucleotide polymorphism.
aaaayccatayaayactccartatttgcyataaara

SEQ ID NO: 140 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 65 to correspond to the nucleotides in an oligonucleotide probe upstream of the discriminating single nucleotide polymorphism.
aayccatayaayactccartatttgcyataaaraa

SEQ ID NO: 141 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 65 to correspond to the nucleotides in an oligonucleotide probe upstream of the discriminating single nucleotide polymorphism.
atygggcctgaraayccatayaayactccartatttgcyataaag

SEQ ID NO: 142 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
gaaaayccatayaayactccartatttgcyataaaran

SEQ ID NO: 143 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
aaaayccatayaayactccartatttgcyataaaraan

SEQ ID NO: 144 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 65 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
ctgaaaayccatayaayactccartatttgcyataaaran

SEQ ID NO: 145 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 65 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
gaaaayccatayaayactccartatttgcyataaaraan

SEQ ID NO: 146 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
cctgaaaayccatayaayactccartatttgcyataaaran

SEQ ID NO: 147 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ctgaaaayccatayaayactccartatttgcyataaaraan

SEQ ID NO: 148 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 65 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ayccatayaayactccartatttgcyataaaran

SEQ ID NO: 149 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 65 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
ccatayaayactccartatttgcyataaaraan

SEQ ID NO: 150 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
aayccatayaayactccartatttgcyataaaran

SEQ ID NO: 151 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ayccatayaayactccartatttgcyataaaraan

SEQ ID NO: 152 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 65 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
aaaayccatayaayactccartatttgcyataaaran

SEQ ID NO: 153 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 65 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
aayccatayaayactccartatttgcyataaaraan

SEQ ID NO: 154 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 65 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
atygggcctgaraayccatayaayactccartatttgcyataaagn

SEQ ID NO: 155 - DNA, 37 bp, Artificial Sequence; identical to SEQ ID NO: 129
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 156 - DNA, 37 bp, Artificial Sequence; identical to SEQ ID NO: 130
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 157 - DNA, 37 bp, Artificial Sequence; identical to SEQ ID NO: 129
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 158 - DNA, 37 bp, Artificial Sequence; identical to SEQ ID NO: 130
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 159 - DNA, 37 bp, Artificial Sequence; identical to SEQ ID NO: 129
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 160 - DNA, 37 bp, Artificial Sequence; identical to SEQ ID NO: 130
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 161 - DNA, 39 bp, Artificial Sequence; identical to SEQ ID NO: 131
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (33)..(39): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 162 - DNA, 38 bp, Artificial Sequence; identical to SEQ ID NO: 132
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 163 - DNA, 39 bp, Artificial Sequence; identical to SEQ ID NO: 131
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (33)..(39): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 164 - DNA, 38 bp, Artificial Sequence; identical to SEQ ID NO: 132
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 165 - DNA, 39 bp, Artificial Sequence; identical to SEQ ID NO: 131
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 166 - DNA, 38 bp, Artificial Sequence; identical to SEQ ID NO: 132
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 167 - DNA, 40 bp, Artificial Sequence; identical to SEQ ID NO: 133
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 168 - DNA, 40 bp, Artificial Sequence; identical to SEQ ID NO: 134
  Pan degenerate oligonucleotide primer
  primer_bind (1)..(40)
  modified_base (1)..(1): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 169 - DNA, 40 bp, Artificial Sequence; identical to SEQ ID NO: 133
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 170 - DNA, 40 bp, Artificial Sequence; identical to SEQ ID NO: 134
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 171 - DNA, 33 bp, Artificial Sequence; identical to SEQ ID NO: 135
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 172 - DNA, 32 bp, Artificial Sequence; identical to SEQ ID NO: 136
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 173 - DNA, 33 bp, Artificial Sequence; identical to SEQ ID NO: 135
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 174 - DNA, 32 bp, Artificial Sequence; identical to SEQ ID NO: 136
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 175 - DNA, 33 bp, Artificial Sequence; identical to SEQ ID NO: 135
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 176 - DNA, 32 bp, Artificial Sequence; identical to SEQ ID NO: 136
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 177 - DNA, 34 bp, Artificial Sequence; identical to SEQ ID NO: 137
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 178 - DNA, 34 bp, Artificial Sequence; identical to SEQ ID NO: 138
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 179 - DNA, 34 bp, Artificial Sequence; identical to SEQ ID NO: 137
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 180 - DNA, 34 bp, Artificial Sequence; identical to SEQ ID NO: 138
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 181 - DNA, 34 bp, Artificial Sequence; identical to SEQ ID NO: 137
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 182 - DNA, 34 bp, Artificial Sequence; identical to SEQ ID NO: 138
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 183 - DNA, 36 bp, Artificial Sequence; identical to SEQ ID NO: 139
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 184 - DNA, 35 bp, Artificial Sequence; identical to SEQ ID NO: 140
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 185 - DNA, 36 bp, Artificial Sequence; identical to SEQ ID NO: 139
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 186 - DNA, 35 bp, Artificial Sequence; identical to SEQ ID NO: 140
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 187 - DNA, 36 bp, Artificial Sequence; identical to SEQ ID NO: 139
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 188 - DNA, 35 bp, Artificial Sequence; identical to SEQ ID NO: 140
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 189 - DNA, 40 bp, Artificial Sequence; identical to SEQ ID NO: 133
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 190 - DNA, 40 bp, Artificial Sequence; identical to SEQ ID NO: 134
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate sense primer that adapts the probe-binding site upstream of codon 65 to correspond to the nucleotides in an oligonucleotide probe upstream of the discriminating single nucleotide polymorphism.

SEQ ID NO: 191 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.
ccatayaayactccartatttgcyataaaraaraar

SEQ ID NO: 192 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.
ccatayaayactccartatttgcyataaaraaraarg

SEQ ID NO: 193 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.
catayaayactccartatttgcyataaaraaraarga

SEQ ID NO: 194 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.
ayccatayaayactccartatttgcyataaaraaraar

SEQ ID NO: 195 - DNA, 39 bp, Artificial Sequence
  Pan degenerate oligonucleotide primer
  primer_bind (1)..(39)
  misc_feature (33)..(39): Adaptor region of the pan degenerate sense primer that adapts the probe-binding site upstream of codon 67 to correspond to the nucleotides in an oligonucleotide probe upstream of the discriminating single nucleotide polymorphism.
ayccatayaayactccartatttgcyataaaraaraarg

SEQ ID NO: 196 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.
ccatayaayactccartatttgcyataaaraaraarga

SEQ ID NO: 197 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.
aaayccatayaayactccartatttgcyataaaraaraar

SEQ ID NO: 198 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.
aayccatayaayactccartatttgcyataaaraaraarg

SEQ ID NO: 199 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.
ayccatayaayactccartatttgcyataaaraaraarga

SEQ ID NO: 200 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.
ayaayactccartatttgcyataaaraaraar

SEQ ID NO: 201 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.
ayaayactccartatttgcyataaaraaraarg

SEQ ID NO: 202 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.
aayactccartatttgcyataaaraaraarga

SEQ ID NO: 203 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.
tayaayactccartatttgcyataaaraaraar

SEQ ID NO: 204 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.
tayaayactccartatttgcyataaaraaraarg

SEQ ID NO: 205 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.
ayaayactccartatttgcyataaaraaraarga

SEQ ID NO: 206 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.
catayaayactccartatttgcyataaaraaraar

SEQ ID NO: 207 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.
catayaayactccartatttgcyataaaraaraarg

SEQ ID NO: 208 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.
tayaayactccartatttgcyataaaraaraarga

SEQ ID NO: 209 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 67 to correspond to the nucleotides in an oligonucleotide probe upstream of the discriminating single nucleotide polymorphism.
cctgaraayccatayaayactccartatttgcyataaagaaaaaa

SEQ ID NO: 210 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ccatayaayactccartatttgcyataaaraaraarn

SEQ ID NO: 211 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ccatayaayactccartatttgcyataaaraaraargn

SEQ ID NO: 212 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
catayaayactccartatttgcyataaaraaraargan

SEQ ID NO: 213 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
ayccatayaayactccartatttgcyataaaraaraarn

SEQ ID NO: 214 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 67 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
ayccatayaayactccartatttgcyataaaraaraargn

SEQ ID NO: 215 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
ccatayaayactccartatttgcyataaaraaraargan

SEQ ID NO: 216 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aaayccatayaayactccartatttgcyataaaraaraarn

SEQ ID NO: 217 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aayccatayaayactccartatttgcyataaaraaraargn

SEQ ID NO: 218 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ayccatayaayactccartatttgcyataaaraaraargan

SEQ ID NO: 219 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
ayaayactccartatttgcyataaaraaraarn

SEQ ID NO: 220 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ayaayactccartatttgcyataaaraaraargn

SEQ ID NO: 221 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
aayactccartatttgcyataaaraaraargan

SEQ ID NO: 222 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tayaayactccartatttgcyataaaraaraarn

SEQ ID NO: 223 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
tayaayactccartatttgcyataaaraaraargn

SEQ ID NO: 224 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ayaayactccartatttgcyataaaraaraargan

SEQ ID NO: 225 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
catayaayactccartatttgcyataaaraaraarn

SEQ ID NO: 226 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
catayaayactccartatttgcyataaaraaraargn

SEQ ID NO: 227 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
tayaayactccartatttgcyataaaraaraargan

SEQ ID NO: 228 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 67 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
cctgaraayccatayaayactccartatttgcyataaagaaaaaan

SEQ ID NO: 229 - DNA, 36 bp, Artificial Sequence; identical to SEQ ID NO: 191
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 230 - DNA, 37 bp, Artificial Sequence; identical to SEQ ID NO: 192
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 231 - DNA, 37 bp, Artificial Sequence; identical to SEQ ID NO: 193
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 232 - DNA, 36 bp, Artificial Sequence; identical to SEQ ID NO: 191
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 233 - DNA, 37 bp, Artificial Sequence; identical to SEQ ID NO: 192
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 234 - DNA, 37 bp, Artificial Sequence; identical to SEQ ID NO: 193
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 235 - DNA, 36 bp, Artificial Sequence; identical to SEQ ID NO: 191
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 236 - DNA, 37 bp, Artificial Sequence; identical to SEQ ID NO: 192
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 237 - DNA, 37 bp, Artificial Sequence; identical to SEQ ID NO: 193
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 238 - DNA, 38 bp, Artificial Sequence; identical to SEQ ID NO: 194
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 239 - DNA, 39 bp, Artificial Sequence; identical to SEQ ID NO: 195
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (33)..(39): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 240 - DNA, 38 bp, Artificial Sequence; identical to SEQ ID NO: 196
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 241 - DNA, 38 bp, Artificial Sequence; identical to SEQ ID NO: 194
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 242 - DNA, 39 bp, Artificial Sequence; identical to SEQ ID NO: 195
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (33)..(39): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 243 - DNA, 38 bp, Artificial Sequence; identical to SEQ ID NO: 196
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 244 - DNA, 38 bp, Artificial Sequence; identical to SEQ ID NO: 194
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 245 - DNA, 39 bp, Artificial Sequence; identical to SEQ ID NO: 195
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 246 - DNA, 38 bp, Artificial Sequence; identical to SEQ ID NO: 196
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 247 - DNA, 40 bp, Artificial Sequence; identical to SEQ ID NO: 197
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 248 - DNA, 40 bp, Artificial Sequence; identical to SEQ ID NO: 198
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 249 - DNA, 40 bp, Artificial Sequence; identical to SEQ ID NO: 199
  Pan degenerate oligonucleotide primer
  primer_bind (1)..(40)
  modified_base (1)..(1): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 250 - DNA, 40 bp, Artificial Sequence; identical to SEQ ID NO: 197
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 251 - DNA, 40 bp, Artificial Sequence; identical to SEQ ID NO: 198
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 252 - DNA, 40 bp, Artificial Sequence; identical to SEQ ID NO: 199
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 253 - DNA, 32 bp, Artificial Sequence; identical to SEQ ID NO: 200
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 254 - DNA, 33 bp, Artificial Sequence; identical to SEQ ID NO: 201
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 255 - DNA, 32 bp, Artificial Sequence; identical to SEQ ID NO: 202
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 256 - DNA, 32 bp, Artificial Sequence; identical to SEQ ID NO: 200
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 257 - DNA, 33 bp, Artificial Sequence; identical to SEQ ID NO: 201
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 258 - DNA, 32 bp, Artificial Sequence; identical to SEQ ID NO: 202
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 259 - DNA, 32 bp, Artificial Sequence; identical to SEQ ID NO: 200
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 260 - DNA, 33 bp, Artificial Sequence; identical to SEQ ID NO: 201
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 261 - DNA, 32 bp, Artificial Sequence; identical to SEQ ID NO: 202
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 262 - DNA, 33 bp, Artificial Sequence; identical to SEQ ID NO: 203
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 263 - DNA, 34 bp, Artificial Sequence; identical to SEQ ID NO: 204
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 264 - DNA, 34 bp, Artificial Sequence; identical to SEQ ID NO: 205
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 265 - DNA, 33 bp, Artificial Sequence; identical to SEQ ID NO: 203
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 266 - DNA, 34 bp, Artificial Sequence; identical to SEQ ID NO: 204
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 267 - DNA, 34 bp, Artificial Sequence; identical to SEQ ID NO: 205
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 268 - DNA, 33 bp, Artificial Sequence; identical to SEQ ID NO: 203
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 269 - DNA, 34 bp, Artificial Sequence; identical to SEQ ID NO: 204
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 270 - DNA, 34 bp, Artificial Sequence; identical to SEQ ID NO: 205
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 271 - DNA, 35 bp, Artificial Sequence; identical to SEQ ID NO: 206
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 272 - DNA, 36 bp, Artificial Sequence; identical to SEQ ID NO: 207
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 273 - DNA, 35 bp, Artificial Sequence; identical to SEQ ID NO: 208
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 274 - DNA, 35 bp, Artificial Sequence; identical to SEQ ID NO: 206
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 275 - DNA, 36 bp, Artificial Sequence; identical to SEQ ID NO: 207
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 276 - DNA, 35 bp, Artificial Sequence; identical to SEQ ID NO: 208
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 277 - DNA, 35 bp, Artificial Sequence; identical to SEQ ID NO: 206
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 278 - DNA, 36 bp, Artificial Sequence; identical to SEQ ID NO: 207
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 279 - DNA, 35 bp, Artificial Sequence; identical to SEQ ID NO: 208
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 280 - DNA, 40 bp, Artificial Sequence; identical to SEQ ID NO: 197
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 281 - DNA, 40 bp, Artificial Sequence; identical to SEQ ID NO: 198
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 282 - DNA, 40 bp, Artificial Sequence; identical to SEQ ID NO: 199
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate sense primer that adapts the probe-binding site upstream of codon 67 to correspond to the nucleotides in an oligonucleotide probe upstream of the discriminating single nucleotide polymorphism.

SEQ ID NO: 283 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 69 to correspond to the nucleotides in an oligonucleotide probe upstream of the discriminating single nucleotide polymorphism.
aayccatayaayactccartatttgcyataaaraaraargacagt

SEQ ID NO: 284 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 69 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aayccatayaayactccartatttgcyataaaraaraargacagtn

SEQ ID NO: 285 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.
actccartatttgcyataaaraaraargayagyacy

SEQ ID NO: 286 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 70 to correspond to the nucleotides in an oligonucleotide probe upstream of the discriminating single nucleotide polymorphism.
actccartatttgcyataaaraaraargayagyacya

SEQ ID NO: 287 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 70 to correspond to the nucleotides in an oligonucleotide probe upstream of the discriminating single nucleotide polymorphism.
ayactccartatttgcyataaaraaraargayagyacy

SEQ ID NO: 288 - DNA, 39 bp, Artificial Sequence
  Pan degenerate oligonucleotide primer
  primer_bind (1)..(39)
  misc_feature (33)..(39): Adaptor region of the pan degenerate sense primer that adapts the probe-binding site upstream of codon 70 to correspond to the nucleotides in an oligonucleotide probe upstream of the discriminating single nucleotide polymorphism.
ayactccartatttgcyataaaraaraargayagyacya

SEQ ID NO: 289 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.
yaayactccartatttgcyataaaraaraargayagyacy

SEQ ID NO: 290 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.
aayactccartatttgcyataaaraaraargayagyacya

SEQ ID NO: 291 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 70 to correspond to the nucleotides in an oligonucleotide probe upstream of the discriminating single nucleotide polymorphism.
cartatttgcyataaaraaraargayagyacy

SEQ ID NO: 292 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.
cartatttgcyataaaraaraargayagyacya

SEQ ID NO: 293 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.
ccartatttgcyataaaraaraargayagyacy

SEQ ID NO: 294 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 70 to correspond to the nucleotides in an oligonucleotide probe upstream of the discriminating single nucleotide polymorphism.
ccartatttgcyataaaraaraargayagyacya

SEQ ID NO: 295 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 70 to correspond to the nucleotides in an oligonucleotide probe upstream of the discriminating single nucleotide polymorphism.
ctccartatttgcyataaaraaraargayagyacy

SEQ ID NO: 296 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.
ctccartatttgcyataaaraaraargayagyacya

SEQ ID NO: 297 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 70 to correspond to the nucleotides in an oligonucleotide probe upstream of the discriminating single nucleotide polymorphism.
ccatayaayactccartatttgcyataaaraaraargacagtact

SEQ ID NO: 298 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
actccartatttgcyataaaraaraargayagyacyn

SEQ ID NO: 299 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 70 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
actccartatttgcyataaaraaraargayagyacyan

SEQ ID NO: 300 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 70 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
ayactccartatttgcyataaaraaraargayagyacyn

SEQ ID NO: 301 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 70 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
ayactccartatttgcyataaaraaraargayagyacyan

SEQ ID NO: 302 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
yaayactccartatttgcyataaaraaraargayagyacyn

SEQ ID NO: 303 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aayactccartatttgcyataaaraaraargayagyacyan

SEQ ID NO: 304 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 70 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
cartatttgcyataaaraaraargayagyacyn

SEQ ID NO: 305 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cartatttgcyataaaraaraargayagyacyan

SEQ ID NO: 306 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ccartatttgcyataaaraaraargayagyacyn

SEQ ID NO: 307 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 70 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ccartatttgcyataaaraaraargayagyacyan

SEQ ID NO: 308 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 70 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
ctccartatttgcyataaaraaraargayagyacyn

SEQ ID NO: 309 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ctccartatttgcyataaaraaraargayagyacyan

SEQ ID NO: 310 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 70 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ccatayaayactccartatttgcyataaaraaraargacagtactn

SEQ ID NO: 311 - DNA, 36 bp, Artificial Sequence; identical to SEQ ID NO: 285
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 312 - DNA, 37 bp, Artificial Sequence; identical to SEQ ID NO: 286
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 313 - DNA, 36 bp, Artificial Sequence; identical to SEQ ID NO: 285
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 314 - DNA, 37 bp, Artificial Sequence; identical to SEQ ID NO: 286
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 315 - DNA, 36 bp, Artificial Sequence; identical to SEQ ID NO: 285
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 316 - DNA, 37 bp, Artificial Sequence; identical to SEQ ID NO: 286
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 317 - DNA, 38 bp, Artificial Sequence; identical to SEQ ID NO: 287
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 318 - DNA, 39 bp, Artificial Sequence; identical to SEQ ID NO: 288
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (33)..(39): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 319 - DNA, 38 bp, Artificial Sequence; identical to SEQ ID NO: 287
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 320 - DNA, 39 bp, Artificial Sequence; identical to SEQ ID NO: 288
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (33)..(39): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 321 - DNA, 38 bp, Artificial Sequence; identical to SEQ ID NO: 287
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 322 - DNA, 39 bp, Artificial Sequence; identical to SEQ ID NO: 288
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 323 - DNA, 40 bp, Artificial Sequence; identical to SEQ ID NO: 289
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 324 - DNA, 40 bp, Artificial Sequence; identical to SEQ ID NO: 290
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 325 - DNA, 40 bp, Artificial Sequence; identical to SEQ ID NO: 289
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 326 - DNA, 40 bp, Artificial Sequence; identical to SEQ ID NO: 290
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 327 - DNA, 32 bp, Artificial Sequence; identical to SEQ ID NO: 291
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 328 - DNA, 33 bp, Artificial Sequence; identical to SEQ ID NO: 292
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 329 - DNA, 32 bp, Artificial Sequence; identical to SEQ ID NO: 291
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 330 - DNA, 33 bp, Artificial Sequence; identical to SEQ ID NO: 292
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 331 - DNA, 32 bp, Artificial Sequence; identical to SEQ ID NO: 291
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 332 - DNA, 33 bp, Artificial Sequence; identical to SEQ ID NO: 292
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 333 - DNA, 33 bp, Artificial Sequence; identical to SEQ ID NO: 293
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 334 - DNA, 34 bp, Artificial Sequence; identical to SEQ ID NO: 294
  Pan degenerate oligonucleotide primer
  primer_bind (1)..(34)
  modified_base (1)..(1): base is a locked nucleic acid
  modified_base (2)..(2): base is a locked nucleic acid
  modified_base (7)..(7): base is a locked nucleic acid
  misc_feature (28)..(34): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 335 - DNA, 33 bp, Artificial Sequence; identical to SEQ ID NO: 293
  Pan degenerate oligonucleotide primer
  primer_bind (1)..(33)
  modified_base (1)..(1): base is a locked nucleic acid
  modified_base (5)..(5): base is a locked nucleic acid
  modified_base (7)..(7): base is a locked nucleic acid
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 336 - DNA, 34 bp, Artificial Sequence; identical to SEQ ID NO: 294
  Pan degenerate oligonucleotide primer
  primer_bind (1)..(34)
  modified_base (1)..(1): base is a locked nucleic acid
  modified_base (5)..(5): base is a locked nucleic acid
  modified_base (7)..(7): base is a locked nucleic acid
  misc_feature (28)..(34): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 337 - DNA, 33 bp, Artificial Sequence; identical to SEQ ID NO: 293
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 338 - DNA, 34 bp, Artificial Sequence; identical to SEQ ID NO: 294
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 339 - DNA, 35 bp, Artificial Sequence; identical to SEQ ID NO: 295
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 340 - DNA, 36 bp, Artificial Sequence; identical to SEQ ID NO: 296
  Pan degenerate oligonucleotide primer
  primer_bind (1)..(36)
  modified_base (1)..(1): base is a locked nucleic acid
  modified_base (3)..(3): base is a locked nucleic acid
  modified_base (7)..(7): base is a locked nucleic acid
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 341 - DNA, 35 bp, Artificial Sequence; identical to SEQ ID NO: 295
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 342 - DNA, 36 bp, Artificial Sequence; identical to SEQ ID NO: 296
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 343 - DNA, 35 bp, Artificial Sequence; identical to SEQ ID NO: 295
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 344 - DNA, 36 bp, Artificial Sequence; identical to SEQ ID NO: 296
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 345 - DNA, 40 bp, Artificial Sequence; identical to SEQ ID NO: 289
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 346 - DNA, 40 bp, Artificial Sequence; identical to SEQ ID NO: 290
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 70 to correspond to the nucleotides in an oligonucleotide probe upstream of the discriminating single nucleotide polymorphism.

SEQ ID NO: 347 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.
gcyataaaraaraargayagyacyaartggagraaa

SEQ ID NO: 348 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.
ttgcyataaaraaraargayagyacyaartggagraaa

SEQ ID NO: 349 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.
atttgcyataaaraaraargayagyacyaartggagraaa

SEQ ID NO: 350 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 74 to correspond to the nucleotides in an oligonucleotide probe upstream of the discriminating single nucleotide polymorphism.
aaraaraargayagyacyaartggagraaa

SEQ ID NO: 351 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.
taaaraaraargayagyacyaartggagraaa

SEQ ID NO: 352 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 74 to correspond to the nucleotides in an oligonucleotide probe upstream of the discriminating single nucleotide polymorphism.
ataaaraaraargayagyacyaartggagraaa

SEQ ID NO: 353 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 74 to correspond to the nucleotides in an oligonucleotide probe upstream of the discriminating single nucleotide polymorphism.
ccartatttgcyataaaraaraargayagyacyaartggagaaaa

SEQ ID NO: 354 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
gcyataaaraaraargayagyacyaartggagraaan

SEQ ID NO: 355 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
ttgcyataaaraaraargayagyacyaartggagraaan

SEQ ID NO: 356 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
atttgcyataaaraaraargayagyacyaartggagraaan

SEQ ID NO: 357 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 74 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
aaraaraargayagyacyaartggagraaan

SEQ ID NO: 358 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
taaaraaraargayagyacyaartggagraaan

SEQ ID NO: 359 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 74 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ataaaraaraargayagyacyaartggagraaan

SEQ ID NO: 360 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 74 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ccartatttgcyataaaraaraargayagyacyaartggagaaaan

SEQ ID NO: 361 - DNA, 36 bp, Artificial Sequence; identical to SEQ ID NO: 347
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 362 - DNA, 36 bp, Artificial Sequence; identical to SEQ ID NO: 347
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 363 - DNA, 36 bp, Artificial Sequence; identical to SEQ ID NO: 347
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 364 - DNA, 38 bp, Artificial Sequence; identical to SEQ ID NO: 348
  Pan degenerate oligonucleotide primer
  primer_bind (1)..(38)
  modified_base (1)..(1): base is a locked nucleic acid
  modified_base (3)..(3): base is a locked nucleic acid
  modified_base (7)..(7): base is a locked nucleic acid
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 365 - DNA, 38 bp, Artificial Sequence; identical to SEQ ID NO: 348
  Pan degenerate oligonucleotide primer
  primer_bind (1)..(38)
  modified_base (1)..(1): base is a locked nucleic acid
  modified_base (6)..(6): base is a locked nucleic acid
  modified_base (7)..(7): base is a locked nucleic acid
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 366 - DNA, 38 bp, Artificial Sequence; identical to SEQ ID NO: 348
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 367 - DNA, 40 bp, Artificial Sequence; identical to SEQ ID NO: 349
  Pan degenerate oligonucleotide primer
  primer_bind (1)..(40)
  modified_base (2)..(2): base is a locked nucleic acid
  modified_base (3)..(3): base is a locked nucleic acid
  modified_base (8)..(8): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 368 - DNA, 40 bp, Artificial Sequence; identical to SEQ ID NO: 349
  Pan degenerate oligonucleotide primer
  primer_bind (1)..(40)
  modified_base (2)..(2): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 369 - DNA, 30 bp, Artificial Sequence; identical to SEQ ID NO: 350
  Pan degenerate oligonucleotide primer
  primer_bind (1)..(30)
  modified_base (1)..(1): base is a locked nucleic acid
  modified_base (4)..(4): base is a locked nucleic acid
  modified_base (8)..(8): base is a locked nucleic acid
  misc_feature (24)..(30): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 370 - DNA, 30 bp, Artificial Sequence; identical to SEQ ID NO: 350
  Pan degenerate oligonucleotide primer
  primer_bind (1)..(30)
  modified_base (1)..(1): base is a locked nucleic acid
  modified_base (7)..(7): base is a locked nucleic acid
  modified_base (8)..(8): base is a locked nucleic acid
  misc_feature (24)..(30): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 371 - DNA, 30 bp, Artificial Sequence; identical to SEQ ID NO: 350
  Pan degenerate oligonucleotide primer
  primer_bind (1)..(30)
  modified_base (1)..(1): base is a locked nucleic acid
  modified_base (4)..(4): base is a locked nucleic acid
  modified_base (7)..(7): base is a locked nucleic acid
  misc_feature (24)..(30): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 372 - DNA, 32 bp, Artificial Sequence; identical to SEQ ID NO: 351
  Pan degenerate oligonucleotide primer
  primer_bind (1)..(32)
  modified_base (1)..(1): base is a locked nucleic acid
  modified_base (3)..(3): base is a locked nucleic acid
  modified_base (9)..(9): base is a locked nucleic acid
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 373 - DNA, 32 bp, Artificial Sequence; identical to SEQ ID NO: 351
  Pan degenerate oligonucleotide primer
  primer_bind (1)..(32)
  modified_base (1)..(1): base is a locked nucleic acid
  modified_base (6)..(6): base is a locked nucleic acid
  modified_base (9)..(9): base is a locked nucleic acid
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 374 - DNA, 32 bp, Artificial Sequence; identical to SEQ ID NO: 351
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 375 - DNA, 33 bp, Artificial Sequence; identical to SEQ ID NO: 352
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 376 - DNA, 33 bp, Artificial Sequence; identical to SEQ ID NO: 352
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 377 - DNA, 33 bp, Artificial Sequence; identical to SEQ ID NO: 352
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 378 - DNA, 40 bp, Artificial Sequence; identical to SEQ ID NO: 349
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 74 to correspond to the nucleotides in an oligonucleotide probe upstream of the discriminating single nucleotide polymorphism.

SEQ ID NO: 379 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 75 to correspond to the nucleotides in an oligonucleotide probe upstream of the discriminating single nucleotide polymorphism.
taaaraaraargayagyacyaartggagraaatta

SEQ ID NO: 380 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.
taaaraaraargayagyacyaartggagraaattag

SEQ ID NO: 381 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.
ataaaraaraargayagyacyaartggagraaatta

SEQ ID NO: 382 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 75 to correspond to the nucleotides in an oligonucleotide probe upstream of the discriminating single nucleotide polymorphism.
ataaaraaraargayagyacyaartggagraaattag

SEQ ID NO: 383 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.
tgcyataaaraaraargayagyacyaartggagraaatta

SEQ ID NO: 384 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.
gcyataaaraaraargayagyacyaartggagraaattag

SEQ ID NO: 385 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaatta

SEQ ID NO: 386 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaattag

SEQ ID NO: 387 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 75 to correspond to the nucleotides in an oligonucleotide probe upstream of the discriminating single nucleotide polymorphism.
aaraargayagyacyaartggagraaatta

SEQ ID NO: 388 - DNA, 31 bp, Artificial Sequence
  Pan degenerate oligonucleotide primer
  primer_bind (1)..(31)
  misc_feature (25)..(31): Adaptor region of the pan degenerate sense primer that adapts the probe-binding site upstream of codon 75 to correspond to the nucleotides in an oligonucleotide probe upstream of the discriminating single nucleotide polymorphism.
aaraargayagyacyaartggagraaattag

SEQ ID NO: 389 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 75 to correspond to the nucleotides in an oligonucleotide probe upstream of the discriminating single nucleotide polymorphism.
aaraaraargayagyacyaartggagraaatta

SEQ ID NO: 390 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 75 to correspond to the nucleotides in an oligonucleotide probe upstream of the discriminating single nucleotide polymorphism.
aaraaraargayagyacyaartggagraaattag

SEQ ID NO: 391 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 75 to correspond to the nucleotides in an oligonucleotide probe upstream of the discriminating single nucleotide polymorphism.
rtatttgcyataaaraaraargayagyacyaartggagraaatta

SEQ ID NO: 392 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 75 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
taaaraaraargayagyacyaartggagraaattan

SEQ ID NO: 393 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
taaaraaraargayagyacyaartggagraaattagn

SEQ ID NO: 394 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ataaaraaraargayagyacyaartggagraaattan

SEQ ID NO: 395 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 75 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ataaaraaraargayagyacyaartggagraaattagn

SEQ ID NO: 396 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
tgcyataaaraaraargayagyacyaartggagraaattan

SEQ ID NO: 397 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gcyataaaraaraargayagyacyaartggagraaattagn

SEQ ID NO: 398 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 75 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
aargayagyacyaartggagraaattan

SEQ ID NO: 399 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 75 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
aargayagyacyaartggagraaattagn

SEQ ID NO: 400 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 75 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
aaraargayagyacyaartggagraaattan

SEQ ID NO: 401 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 75 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
aaraargayagyacyaartggagraaattagn

SEQ ID NO: 402 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 75 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
aaraaraargayagyacyaartggagraaattan

SEQ ID NO: 403 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 75 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
aaraaraargayagyacyaartggagraaattagn

SEQ ID NO: 404 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 75 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
rtatttgcyataaaraaraargayagyacyaartggagraaattan

SEQ ID NO: 405 - DNA, 35 bp, Artificial Sequence; identical to SEQ ID NO: 379
  Pan degenerate oligonucleotide primer
  primer_bind (1)..(35)
  modified_base (1)..(1): base is a locked nucleic acid
  modified_base (3)..(3): base is a locked nucleic acid
  modified_base (9)..(9): base is a locked nucleic acid
  misc_feature (29)..(35): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 406 - DNA, 36 bp, Artificial Sequence; identical to SEQ ID NO: 380
  Pan degenerate oligonucleotide primer
  primer_bind (1)..(36)
  modified_base (1)..(1): base is a locked nucleic acid
  modified_base (3)..(3): base is a locked nucleic acid
  modified_base (9)..(9): base is a locked nucleic acid
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 407 - DNA, 35 bp, Artificial Sequence; identical to SEQ ID NO: 379
  Pan degenerate oligonucleotide primer
  primer_bind (1)..(35)
  modified_base (1)..(1): base is a locked nucleic acid
  modified_base (6)..(6): base is a locked nucleic acid
  modified_base (9)..(9): base is a locked nucleic acid
  misc_feature (29)..(35): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 408 - DNA, 36 bp, Artificial Sequence; identical to SEQ ID NO: 380
  Pan degenerate oligonucleotide primer
  primer_bind (1)..(36)
  modified_base (1)..(1): base is a locked nucleic acid
  modified_base (6)..(6): base is a locked nucleic acid
  modified_base (9)..(9): base is a locked nucleic acid
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 409 - DNA, 35 bp, Artificial Sequence; identical to SEQ ID NO: 379
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 410 - DNA, 36 bp, Artificial Sequence; identical to SEQ ID NO: 380
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 411 - DNA, 36 bp, Artificial Sequence; identical to SEQ ID NO: 381
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 412 - DNA, 37 bp, Artificial Sequence; identical to SEQ ID NO: 382
  Pan degenerate oligonucleotide primer
  primer_bind (1)..(37)
  modified_base (1)..(1): base is a locked nucleic acid
  modified_base (2)..(2): base is a locked nucleic acid
  modified_base (7)..(7): base is a locked nucleic acid
  misc_feature (31)..(37): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 413 - DNA, 36 bp, Artificial Sequence; identical to SEQ ID NO: 381
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 414 - DNA, 37 bp, Artificial Sequence; identical to SEQ ID NO: 382
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 415 - DNA, 36 bp, Artificial Sequence; identical to SEQ ID NO: 381
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 416 - DNA, 37 bp, Artificial Sequence; identical to SEQ ID NO: 382
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 417 - DNA, 40 bp, Artificial Sequence; identical to SEQ ID NO: 383
  Pan degenerate oligonucleotide primer
  primer_bind (1)..(40)
  modified_base (2)..(2): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 418 - DNA, 40 bp, Artificial Sequence; identical to SEQ ID NO: 384
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 419 - DNA, 40 bp, Artificial Sequence; identical to SEQ ID NO: 383
  Pan degenerate oligonucleotide primer
  primer_bind (1)..(40)
  modified_base (2)..(2): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 420 - DNA, 40 bp, Artificial Sequence; identical to SEQ ID NO: 384
  Pan degenerate oligonucleotide primer
  primer_bind (1)..(40)
  modified_base (1)..(1): base is a locked nucleic acid
  modified_base (5)..(5): base is a locked nucleic acid
  modified_base (7)..(7): base is a locked nucleic acid
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 421 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (16)..(16): base is a locked nucleic acid
  misc_feature (21)..(27): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaatta

SEQ ID NO: 422 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (16)..(16): base is a locked nucleic acid
  misc_feature (22)..(28): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaattag

SEQ ID NO: 423 - DNA, 27 bp, Artificial Sequence
  Pan degenerate oligonucleotide primer
  primer_bind (1)..(27)
  modified_base (1)..(1): base is a locked nucleic acid
  modified_base (13)..(13): base is a locked nucleic acid
  modified_base (16)..(16): base is a locked nucleic acid
  misc_feature (21)..(27): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaatta

SEQ ID NO: 424 - DNA, 28 bp, Artificial Sequence
  Pan degenerate oligonucleotide primer
  primer_bind (1)..(28)
  modified_base (1)..(1): base is a locked nucleic acid
  modified_base (13)..(13): base is a locked nucleic acid
  modified_base (16)..(16): base is a locked nucleic acid
  misc_feature (22)..(28): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaattag

SEQ ID NO: 425 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (13)..(13): base is a locked nucleic acid
  misc_feature (21)..(27): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaatta

SEQ ID NO: 426 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (13)..(13): base is a locked nucleic acid
  misc_feature (22)..(28): Adaptor region of the pan degenerate sense primer that adapts the probe-binding site upstream of codon 75 to correspond to the nucleotides in an oligonucleotide probe upstream of the discriminating single nucleotide polymorphism.
aargayagyacyaartggagraaattag

SEQ ID NO: 427 - DNA, 30 bp, Artificial Sequence; identical to SEQ ID NO: 387
  Pan degenerate oligonucleotide primer
  primer_bind (1)..(30)
  modified_base (1)..(1): base is a locked nucleic acid
  modified_base (4)..(4): base is a locked nucleic acid
  modified_base (16)..(16): base is a locked nucleic acid
  misc_feature (24)..(30): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 428 - DNA, 31 bp, Artificial Sequence; identical to SEQ ID NO: 388
  Pan degenerate oligonucleotide primer
  primer_bind (1)..(31)
  modified_base (1)..(1): base is a locked nucleic acid
  modified_base (4)..(4): base is a locked nucleic acid
  modified_base (16)..(16): base is a locked nucleic acid
  misc_feature (25)..(31): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 429 - DNA, 30 bp, Artificial Sequence; identical to SEQ ID NO: 387
  Pan degenerate oligonucleotide primer
  primer_bind (1)..(30)
  modified_base (1)..(1): base is a locked nucleic acid
  modified_base (5)..(5): base is a locked nucleic acid
  modified_base (16)..(16): base is a locked nucleic acid
  misc_feature (24)..(30): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 430 - DNA, 31 bp, Artificial Sequence; identical to SEQ ID NO: 388
  Pan degenerate oligonucleotide primer
  primer_bind (1)..(31)
  modified_base (1)..(1): base is a locked nucleic acid
  modified_base (5)..(5): base is a locked nucleic acid
  modified_base (16)..(16): base is a locked nucleic acid
  misc_feature (25)..(31): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 431 - DNA, 30 bp, Artificial Sequence; identical to SEQ ID NO: 387
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 432 - DNA, 31 bp, Artificial Sequence; identical to SEQ ID NO: 388
  Pan degenerate oligonucleotide primer
  primer_bind (1)..(31)
  modified_base (1)..(1): base is a locked nucleic acid
  modified_base (4)..(4): base is a locked nucleic acid
  modified_base (5)..(5): base is a locked nucleic acid
  misc_feature (25)..(31): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 433 - DNA, 33 bp, Artificial Sequence; identical to SEQ ID NO: 389
  Pan degenerate oligonucleotide primer
  primer_bind (1)..(33)
  modified_base (1)..(1): base is a locked nucleic acid
  modified_base (4)..(4): base is a locked nucleic acid
  modified_base (8)..(8): base is a locked nucleic acid
  misc_feature (27)..(33): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 434 - DNA, 34 bp, Artificial Sequence; identical to SEQ ID NO: 390
  Pan degenerate oligonucleotide primer
  primer_bind (1)..(34)
  modified_base (1)..(1): base is a locked nucleic acid
  modified_base (4)..(4): base is a locked nucleic acid
  modified_base (8)..(8): base is a locked nucleic acid
  misc_feature (28)..(34): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 435 - DNA, 33 bp, Artificial Sequence; identical to SEQ ID NO: 389
  Pan degenerate oligonucleotide primer
  primer_bind (1)..(33)
  modified_base (1)..(1): base is a locked nucleic acid
  modified_base (7)..(7): base is a locked nucleic acid
  modified_base (8)..(8): base is a locked nucleic acid
  misc_feature (27)..(33): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 436 - DNA, 34 bp, Artificial Sequence; identical to SEQ ID NO: 390
  Pan degenerate oligonucleotide primer
  primer_bind (1)..(34)
  modified_base (1)..(1): base is a locked nucleic acid
  modified_base (7)..(7): base is a locked nucleic acid
  modified_base (8)..(8): base is a locked nucleic acid
  misc_feature (28)..(34): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 437 - DNA, 33 bp, Artificial Sequence; identical to SEQ ID NO: 389
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 438 - DNA, 34 bp, Artificial Sequence; identical to SEQ ID NO: 390
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 439 - DNA, 40 bp, Artificial Sequence; identical to SEQ ID NO: 383
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 440 - DNA, 40 bp, Artificial Sequence; identical to SEQ ID NO: 384
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 75 to correspond to the nucleotides in an oligonucleotide probe upstream of the discriminating single nucleotide polymorphism.

SEQ ID NO: 441 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 77 to correspond to the nucleotides in an oligonucleotide probe upstream of the discriminating single nucleotide polymorphism.
argayagyacyaartggagraaattagtagaytt

SEQ ID NO: 442 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 77 to correspond to the nucleotides in an oligonucleotide probe upstream of the discriminating single nucleotide polymorphism.
aargayagyacyaartggagraaattagtagaytt

SEQ ID NO: 443 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 77 to correspond to the nucleotides in an oligonucleotide probe upstream of the discriminating single nucleotide polymorphism.
araaraargayagyacyaartggagraaattagtagaytt

SEQ ID NO: 444 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 77 to correspond to the nucleotides in an oligonucleotide probe upstream of the discriminating single nucleotide polymorphism.
aartggagraaattagtagaytt

SEQ ID NO: 445 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 77 to correspond to the nucleotides in an oligonucleotide probe upstream of the discriminating single nucleotide polymorphism.
gcyataaaraaraargayagyacyaartggagraaattagtagat

SEQ ID NO: 446 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 77 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
argayagyacyaartggagraaattagtagayttn

SEQ ID NO: 447 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 77 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
aargayagyacyaartggagraaattagtagayttn

SEQ ID NO: 448 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 77 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
araaraargayagyacyaartggagraaattagtagayttn

SEQ ID NO: 449 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 77 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
aartggagraaattagtagayttn

SEQ ID NO: 450 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 77 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gcyataaaraaraargayagyacyaartggagraaattagtagatn

SEQ ID NO: 451 - DNA, 34 bp, Artificial Sequence; identical to SEQ ID NO: 441
  Pan degenerate oligonucleotide primer
  primer_bind (1)..(34)
  modified_base (1)..(1): base is a locked nucleic acid
  modified_base (12)..(12): base is a locked nucleic acid
  modified_base (16)..(16): base is a locked nucleic acid
  misc_feature (28)..(34): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 452 - DNA, 34 bp, Artificial Sequence; identical to SEQ ID NO: 441
  Pan degenerate oligonucleotide primer
  primer_bind (1)..(34)
  modified_base (1)..(1): base is a locked nucleic acid
  modified_base (15)..(15): base is a locked nucleic acid
  modified_base (16)..(16): base is a locked nucleic acid
  misc_feature (28)..(34): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 453 - DNA, 34 bp, Artificial Sequence; identical to SEQ ID NO: 441
  Pan degenerate oligonucleotide primer
  primer_bind (1)..(34)
  modified_base (1)..(1): base is a locked nucleic acid
  modified_base (12)..(12): base is a locked nucleic acid
  modified_base (15)..(15): base is a locked nucleic acid
  misc_feature (28)..(34): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 454 - DNA, 35 bp, Artificial Sequence; identical to SEQ ID NO: 442
  Pan degenerate oligonucleotide primer
  primer_bind (1)..(35)
  modified_base (1)..(1): base is a locked nucleic acid
  modified_base (2)..(2): base is a locked nucleic acid
  modified_base (16)..(16): base is a locked nucleic acid
  misc_feature (29)..(35): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 455 - DNA, 35 bp, Artificial Sequence; identical to SEQ ID NO: 442
  Pan degenerate oligonucleotide primer
  primer_bind (1)..(35)
  modified_base (1)..(1): base is a locked nucleic acid
  modified_base (13)..(13): base is a locked nucleic acid
  modified_base (16)..(16): base is a locked nucleic acid
  misc_feature (29)..(35): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 456 - DNA, 35 bp, Artificial Sequence; identical to SEQ ID NO: 442
  Pan degenerate oligonucleotide primer
  primer_bind (1)..(35)
  modified_base (1)..(1): base is a locked nucleic acid
  modified_base (2)..(2): base is a locked nucleic acid
  modified_base (13)..(13): base is a locked nucleic acid
  misc_feature (29)..(35): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 457 - DNA, 40 bp, Artificial Sequence; identical to SEQ ID NO: 443
  Pan degenerate oligonucleotide primer
  primer_bind (1)..(40)
  modified_base (3)..(3): base is a locked nucleic acid
  modified_base (6)..(6): base is a locked nucleic acid
  modified_base (18)..(18): base is a locked nucleic acid
  misc_feature (34)..(40): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 458 - DNA, 40 bp, Artificial Sequence; identical to SEQ ID NO: 443
  Pan degenerate oligonucleotide primer
  primer_bind (1)..(40)
  modified_base (3)..(3): base is a locked nucleic acid
  modified_base (7)..(7): base is a locked nucleic acid
  modified_base (18)..(18): base is a locked nucleic acid
  misc_feature (34)..(40): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 459 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (6)..(6): base is a locked nucleic acid
  misc_feature (17)..(23): Adaptor region of the pan degenerate sense primer that adapts the probe-binding site upstream of codon 77 to correspond to the nucleotides in an oligonucleotide probe upstream of the discriminating single nucleotide polymorphism.
aartggagraaattagtagaytt

SEQ ID NO: 460 - DNA, 23 bp, Artificial Sequence
  Pan degenerate oligonucleotide primer
  primer_bind (1)..(23)
  modified_base (1)..(1): base is a locked nucleic acid
  modified_base (5)..(5): base is a locked nucleic acid
  modified_base (6)..(6): base is a locked nucleic acid
  misc_feature (17)..(23): Adaptor region of the pan degenerate sense primer that adapts the probe-binding site upstream of codon 77 to correspond to the nucleotides in an oligonucleotide probe upstream of the discriminating single nucleotide polymorphism.
aartggagraaattagtagaytt

SEQ ID NO: 461 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (5)..(5): base is a locked nucleic acid
  misc_feature (17)..(23): Adaptor region of the pan degenerate sense primer that adapts the probe-binding site upstream of codon 77 to correspond to the nucleotides in an oligonucleotide probe upstream of the discriminating single nucleotide polymorphism.
aartggagraaattagtagaytt

SEQ ID NO: 462 - DNA, 40 bp, Artificial Sequence; identical to SEQ ID NO: 443
  Pan degenerate oligonucleotide primer
  primer_bind (1)..(40)
  modified_base (3)..(3): base is a locked nucleic acid
  modified_base (6)..(6): base is a locked nucleic acid
  modified_base (7)..(7): base is a locked nucleic acid
  misc_feature (34)..(40): Adaptor region of the pan degenerate sense primer that adapts the probe-binding site upstream of codon 77 to correspond to the nucleotides in an oligonucleotide probe upstream of the discriminating single nucleotide polymorphism.

SEQ ID NO: 463 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 90 to correspond to the nucleotides in an oligonucleotide probe upstream of the discriminating single nucleotide polymorphism.
garctyaataaragaactcargayttytgggar

SEQ ID NO: 464 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.
grgarctyaataaragaactcargayttytgggar

SEQ ID NO: 465 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.
yttyagrgarctyaataaragaactcargayttytgggar

SEQ ID NO: 466 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
tyaataaragaactcargayttytgggar

SEQ ID NO: 467 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.
ctyaataaragaactcargayttytgggar

SEQ ID NO: 468 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.
arctyaataaragaactcargayttytgggar

SEQ ID NO: 469 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 90 to correspond to the nucleotides in an oligonucleotide probe upstream of the discriminating single nucleotide polymorphism.
gtrgayttyagrgarctyaataararaactcargayttctgggaa

SEQ ID NO: 470 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 90 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
garctyaataaragaactcargayttytgggarn

SEQ ID NO: 471 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
grgarctyaataaragaactcargayttytgggarn

SEQ ID NO: 472 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
yttyagrgarctyaataaragaactcargayttytgggarn

SEQ ID NO: 473 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
tyaataaragaactcargayttytgggarn

SEQ ID NO: 474 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
ctyaataaragaactcargayttytgggarn

SEQ ID NO: 475 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
arctyaataaragaactcargayttytgggarn

SEQ ID NO: 476 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 90 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gtrgayttyagrgarctyaataararaactcargayttctgggaan

SEQ ID NO: 477 - DNA, 33 bp, Artificial Sequence; identical to SEQ ID NO: 463
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 478 - DNA, 33 bp, Artificial Sequence; identical to SEQ ID NO: 463
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 479 - DNA, 33 bp, Artificial Sequence; identical to SEQ ID NO: 463
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 480 - DNA, 35 bp, Artificial Sequence; identical to SEQ ID NO: 464
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 481 - DNA, 35 bp, Artificial Sequence; identical to SEQ ID NO: 464
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 482 - DNA, 35 bp, Artificial Sequence; identical to SEQ ID NO: 464
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 483 - DNA, 40 bp, Artificial Sequence; identical to SEQ ID NO: 465
  Pan degenerate oligonucleotide primer
  primer_bind (1)..(40)
  modified_base (3)..(3): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 484 - DNA, 40 bp, Artificial Sequence; identical to SEQ ID NO: 465
  Pan degenerate oligonucleotide primer
  primer_bind (1)..(40)
  modified_base (3)..(3): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 485 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
tyaataaragaactcargayttytgggar

SEQ ID NO: 486 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
tyaataaragaactcargayttytgggar

SEQ ID NO: 487 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 90 to correspond to the nucleotides in an oligonucleotide probe upstream of the discriminating single nucleotide polymorphism.
tyaataaragaactcargayttytgggar

SEQ ID NO: 488 - DNA, 30 bp, Artificial Sequence; identical to SEQ ID NO: 467
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 489 - DNA, 30 bp, Artificial Sequence; identical to SEQ ID NO: 467
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 490 - DNA, 30 bp, Artificial Sequence; identical to SEQ ID NO: 467
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 491 - DNA, 32 bp, Artificial Sequence; identical to SEQ ID NO: 468
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 492 - DNA, 32 bp, Artificial Sequence; identical to SEQ ID NO: 468
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 493 - DNA, 32 bp, Artificial Sequence; identical to SEQ ID NO: 468
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 494 - DNA, 40 bp, Artificial Sequence; identical to SEQ ID NO: 465
  Pan degenerate oligonucleotide primer
  primer_bind (1)..(40)
  modified_base (3)..(3): base is a locked nucleic acid
  modified_base (6)..(6): base is a locked nucleic acid
  modified_base (8)..(8): base is a locked nucleic acid
  misc_feature (34)..(40): Adaptor region of the pan degenerate sense primer that adapts the probe-binding site upstream of codon 90 to correspond to the nucleotides in an oligonucleotide probe upstream of the discriminating single nucleotide polymorphism.

SEQ ID NO: 495 - DNA, 37 bp, Artificial Sequence
  Pan degenerate oligonucleotide primer
  primer_bind (1)..(37)
  misc_feature (30)..(30): n is a, c, g, or t
  misc_feature (31)..(37): Adaptor region of the pan degenerate sense primer that adapts the probe-binding site upstream of codon 98 to correspond to the nucleotides in an oligonucleotide probe upstream of the discriminating single nucleotide polymorphism.
gayttytgggargtycaattaggrataccncaycchg

SEQ ID NO: 496 - DNA, 39 bp, Artificial Sequence
  Pan degenerate oligonucleotide primer
  primer_bind (1)..(39)
  misc_feature (32)..(32): n is a, c, g, or t
  misc_feature (33)..(39): Adaptor region of the pan degenerate sense primer that adapts the probe-binding site upstream of codon 98 to correspond to the nucleotides in an oligonucleotide probe upstream of the discriminating single nucleotide polymorphism.
argayttytgggargtycaattaggrataccncaycchg

SEQ ID NO: 497 - DNA, 40 bp, Artificial Sequence
  Pan degenerate oligonucleotide primer
  primer_bind (1)..(40)
  misc_feature (33)..(33): n is a, c, g, or t
  misc_feature (34)..(40): Adaptor region of the pan degenerate sense primer that adapts the probe-binding site upstream of codon 98 to correspond to the nucleotides in an oligonucleotide probe upstream of the discriminating single nucleotide polymorphism.
cargayttytgggargtycaattaggrataccncaycchg

SEQ ID NO: 498 - DNA, 33 bp, Artificial Sequence
  Pan degenerate oligonucleotide primer
  primer_bind (1)..(33)
  misc_feature (26)..(26): n is a, c, g, or t
  misc_feature (27)..(33): Adaptor region of the pan degenerate sense primer that adapts the probe-binding site upstream of codon 98 to correspond to the nucleotides in an oligonucleotide probe upstream of the discriminating single nucleotide polymorphism.
tytgggargtycaattaggrataccncaycchg

SEQ ID NO: 499 - DNA, 34 bp, Artificial Sequence
  Pan degenerate oligonucleotide primer
  primer_bind (1)..(34)
  misc_feature (27)..(27): n is a, c, g, or t
  misc_feature (28)..(34): Adaptor region of the pan degenerate sense primer that adapts the probe-binding site upstream of codon 98 to correspond to the nucleotides in an oligonucleotide probe upstream of the discriminating single nucleotide polymorphism.
ttytgggargtycaattaggrataccncaycchg

SEQ ID NO: 500 - DNA, 36 bp, Artificial Sequence
  Pan degenerate oligonucleotide primer
  primer_bind (1)..(36)
  misc_feature (29)..(29): n is a, c, g, or t
  misc_feature (30)..(36): Adaptor region of the pan degenerate sense primer that adapts the probe-binding site upstream of codon 98 to correspond to the nucleotides in an oligonucleotide probe upstream of the discriminating single nucleotide polymorphism.
ayttytgggargtycaattaggrataccncaycchg

SEQ ID NO: 501 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 98 to correspond to the nucleotides in an oligonucleotide probe upstream of the discriminating single nucleotide polymorphism.
araactcargayttytgggargtycarttaggrataccdcatcca

SEQ ID NO: 502 - DNA, 38 bp, Artificial Sequence
  Pan degenerate oligonucleotide primer
  primer_bind (1)..(38)
  misc_feature (30)..(30): n is a, c, g, or t
  misc_feature (31)..(37): Adaptor region of the pan degenerate sense primer that adapts the probe-binding site upstream of codon 98 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
gayttytgggargtycaattaggrataccncaycchgn

SEQ ID NO: 503 - DNA, 40 bp, Artificial Sequence
  Pan degenerate oligonucleotide primer
  primer_bind (1)..(40)
  misc_feature (32)..(32): n is a, c, g, or t
  misc_feature (33)..(39): Adaptor region of the pan degenerate sense primer that adapts the probe-binding site upstream of codon 98 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
argayttytgggargtycaattaggrataccncaycchgn

SEQ ID NO: 504 - DNA, 41 bp, Artificial Sequence
  Pan degenerate oligonucleotide primer
  primer_bind (1)..(41)
  misc_feature (33)..(33): n is a, c, g, or t
  misc_feature (34)..(40): Adaptor region of the pan degenerate sense primer that adapts the probe-binding site upstream of codon 98 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
cargayttytgggargtycaattaggrataccncaycchgn

SEQ ID NO: 505 - DNA, 34 bp, Artificial Sequence
  Pan degenerate oligonucleotide primer
  primer_bind (1)..(34)
  misc_feature (26)..(26): n is a, c, g, or t
  misc_feature (27)..(33): Adaptor region of the pan degenerate sense primer that adapts the probe-binding site upstream of codon 98 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tytgggargtycaattaggrataccncaycchgn

SEQ ID NO: 506 - DNA, 35 bp, Artificial Sequence
  Pan degenerate oligonucleotide primer
  primer_bind (1)..(35)
  misc_feature (27)..(27): n is a, c, g, or t
  misc_feature (28)..(34): Adaptor region of the pan degenerate sense primer that adapts the probe-binding site upstream of codon 98 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ttytgggargtycaattaggrataccncaycchgn

SEQ ID NO: 507 - DNA, 37 bp, Artificial Sequence
  Pan degenerate oligonucleotide primer
  primer_bind (1)..(37)
  misc_feature (29)..(29): n is a, c, g, or t
  misc_feature (30)..(36): Adaptor region of the pan degenerate sense primer that adapts the probe-binding site upstream of codon 98 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ayttytgggargtycaattaggrataccncaycchgn

SEQ ID NO: 508 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 98 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
araactcargayttytgggargtycarttaggrataccdcatccan

SEQ ID NO: 509 - DNA, 37 bp, Artificial Sequence; identical to SEQ ID NO: 495
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (30)..(30): n is a, c, g, or t
  misc_feature (31)..(37): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 510 - DNA, 37 bp, Artificial Sequence; identical to SEQ ID NO: 495
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (30)..(30): n is a, c, g, or t
  misc_feature (31)..(37): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 511 - DNA, 37 bp, Artificial Sequence; identical to SEQ ID NO: 495
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (30)..(30): n is a, c, g, or t
  misc_feature (31)..(37): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 512 - DNA, 39 bp, Artificial Sequence; identical to SEQ ID NO: 496
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (32)..(32): n is a, c, g, or t
  misc_feature (33)..(39): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 513 - DNA, 39 bp, Artificial Sequence; identical to SEQ ID NO: 496
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (32)..(32): n is a, c, g, or t
  misc_feature (33)..(39): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 514 - DNA, 39 bp, Artificial Sequence; identical to SEQ ID NO: 496
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (32)..(32): n is a, c, g, or t
  misc_feature (33)..(39): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 515 - DNA, 40 bp, Artificial Sequence; identical to SEQ ID NO: 497
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (33)..(33): n is a, c, g, or t
  misc_feature (34)..(40): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 516 - DNA, 40 bp, Artificial Sequence; identical to SEQ ID NO: 497
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (33)..(33): n is a, c, g, or t
  misc_feature (34)..(40): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 517 - DNA, 33 bp, Artificial Sequence; identical to SEQ ID NO: 498
  Pan degenerate oligonucleotide primer
  primer_bind (1)..(33)
  modified_base (1)..(1): base is a locked nucleic acid
  modified_base (3)..(3): base is a locked nucleic acid
  modified_base (7)..(7): base is a locked nucleic acid
  misc_feature (26)..(26): n is a, c, g, or t
  misc_feature (27)..(33): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 518 - DNA, 33 bp, Artificial Sequence; identical to SEQ ID NO: 498
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (26)..(26): n is a, c, g, or t
  misc_feature (27)..(33): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 519 - DNA, 33 bp, Artificial Sequence; identical to SEQ ID NO: 498
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (26)..(26): n is a, c, g, or t
  misc_feature (27)..(33): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 520 - DNA, 34 bp, Artificial Sequence; identical to SEQ ID NO: 499
  Pan degenerate oligonucleotide primer
  primer_bind (1)..(34)
  modified_base (1)..(1): base is a locked nucleic acid
  modified_base (2)..(2): base is a locked nucleic acid
  modified_base (7)..(7): base is a locked nucleic acid
  misc_feature (27)..(27): n is a, c, g, or t
  misc_feature (28)..(34): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 521 - DNA, 34 bp, Artificial Sequence; identical to SEQ ID NO: 499
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (27)..(27): n is a, c, g, or t
  misc_feature (28)..(34): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 522 - DNA, 34 bp, Artificial Sequence; identical to SEQ ID NO: 499
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (27)..(27): n is a, c, g, or t
  misc_feature (28)..(34): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 523 - DNA, 36 bp, Artificial Sequence; identical to SEQ ID NO: 500
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (29)..(29): n is a, c, g, or t
  misc_feature (30)..(36): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 524 - DNA, 36 bp, Artificial Sequence; identical to SEQ ID NO: 500
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (29)..(29): n is a, c, g, or t
  misc_feature (30)..(36): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 525 - DNA, 36 bp, Artificial Sequence; identical to SEQ ID NO: 500
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (29)..(29): n is a, c, g, or t
  misc_feature (30)..(36): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 526 - DNA, 40 bp, Artificial Sequence; identical to SEQ ID NO: 497
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (33)..(33): n is a, c, g, or t
  misc_feature (34)..(40): Adaptor region of the pan degenerate sense primer that adapts the probe-binding site upstream of codon 98 to correspond to the nucleotides in an oligonucleotide probe upstream of the discriminating single nucleotide polymorphism.

SEQ ID NO: 527 - DNA, 36 bp, Artificial Sequence
  Pan degenerate oligonucleotide primer
  primer_bind (1)..(36)
  misc_feature (24)..(24): n is a, c, g, or t
  misc_feature (30)..(36): Adaptor region of the pan degenerate sense primer that adapts the probe-binding site upstream of codon 100 to correspond to the nucleotides in an oligonucleotide probe upstream of the discriminating single nucleotide polymorphism.
tgggargtycaattaggrataccncaycchgcrggd

SEQ ID NO: 528 - DNA, 38 bp, Artificial Sequence
  Pan degenerate oligonucleotide primer
  primer_bind (1)..(38)
  misc_feature (26)..(26): n is a, c, g, or t
  misc_feature (32)..(38): Adaptor region of the pan degenerate sense primer that adapts the probe-binding site upstream of codon 100 to correspond to the nucleotides in an oligonucleotide probe upstream of the discriminating single nucleotide polymorphism.
tytgggargtycaattaggrataccncaycchgcrggd

SEQ ID NO: 529 - DNA, 40 bp, Artificial Sequence
  Pan degenerate oligonucleotide primer
  primer_bind (1)..(40)
  misc_feature (28)..(28): n is a, c, g, or t
  misc_feature (34)..(40): Adaptor region of the pan degenerate sense primer that adapts the probe-binding site upstream of codon 100 to correspond to the nucleotides in an oligonucleotide probe upstream of the discriminating single nucleotide polymorphism.
yttytgggargtycaattaggrataccncaycchgcrggd

SEQ ID NO: 530 - DNA, 29 bp, Artificial Sequence
  Pan degenerate oligonucleotide primer
  primer_bind (1)..(29)
  misc_feature (17)..(17): n is a, c, g, or t
  misc_feature (23)..(29): Adaptor region of the pan degenerate sense primer that adapts the probe-binding site upstream of codon 100 to correspond to the nucleotides in an oligonucleotide probe upstream of the discriminating single nucleotide polymorphism.
tycaattaggrataccncaycchgcrggd

SEQ ID NO: 531 - DNA, 32 bp, Artificial Sequence
  Pan degenerate oligonucleotide primer
  primer_bind (1)..(32)
  misc_feature (20)..(20): n is a, c, g, or t
  misc_feature (26)..(32): Adaptor region of the pan degenerate sense primer that adapts the probe-binding site upstream of codon 100 to correspond to the nucleotides in an oligonucleotide probe upstream of the discriminating single nucleotide polymorphism.
argtycaattaggrataccncaycchgcrggd

SEQ ID NO: 532 - DNA, 33 bp, Artificial Sequence
  Pan degenerate oligonucleotide primer
  primer_bind (1)..(33)
  misc_feature (21)..(21): n is a, c, g, or t
  misc_feature (27)..(33): Adaptor region of the pan degenerate sense primer that adapts the probe-binding site upstream of codon 100 to correspond to the nucleotides in an oligonucleotide probe upstream of the discriminating single nucleotide polymorphism.
gargtycaattaggrataccncaycchgcrggd

SEQ ID NO: 533 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 100 to correspond to the nucleotides in an oligonucleotide probe upstream of the discriminating single nucleotide polymorphism.
cargayttytgggargtycarttaggrataccdcayccagcaggg

SEQ ID NO: 534 - DNA, 37 bp, Artificial Sequence
  Pan degenerate oligonucleotide primer
  primer_bind (1)..(37)
  misc_feature (24)..(24): n is a, c, g, or t
  misc_feature (30)..(36): Adaptor region of the pan degenerate sense primer that adapts the probe-binding site upstream of codon 100 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
tgggargtycaattaggrataccncaycchgcrggdn

SEQ ID NO: 535 - DNA, 39 bp, Artificial Sequence
  Pan degenerate oligonucleotide primer
  primer_bind (1)..(39)
  misc_feature (26)..(26): n is a, c, g, or t
  misc_feature (32)..(38): Adaptor region of the pan degenerate sense primer that adapts the probe-binding site upstream of codon 100 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
tytgggargtycaattaggrataccncaycchgcrggdn

SEQ ID NO: 536 - DNA, 41 bp, Artificial Sequence
  Pan degenerate oligonucleotide primer
  primer_bind (1)..(41)
  misc_feature (28)..(28): n is a, c, g, or t
  misc_feature (34)..(40): Adaptor region of the pan degenerate sense primer that adapts the probe-binding site upstream of codon 100 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
yttytgggargtycaattaggrataccncaycchgcrggdn

SEQ ID NO: 537 - DNA, 30 bp, Artificial Sequence
  Pan degenerate oligonucleotide primer
  primer_bind (1)..(30)
  misc_feature (17)..(17): n is a, c, g, or t
  misc_feature (23)..(29): Adaptor region of the pan degenerate sense primer that adapts the probe-binding site upstream of codon 100 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
tycaattaggrataccncaycchgcrggdn

SEQ ID NO: 538 - DNA, 33 bp, Artificial Sequence
  Pan degenerate oligonucleotide primer
  primer_bind (1)..(33)
  misc_feature (20)..(20): n is a, c, g, or t
  misc_feature (26)..(32): Adaptor region of the pan degenerate sense primer that adapts the probe-binding site upstream of codon 100 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
argtycaattaggrataccncaycchgcrggdn

SEQ ID NO: 539 - DNA, 34 bp, Artificial Sequence
  Pan degenerate oligonucleotide primer
  primer_bind (1)..(34)
  misc_feature (21)..(21): n is a, c, g, or t
  misc_feature (27)..(33): Adaptor region of the pan degenerate sense primer that adapts the probe-binding site upstream of codon 100 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
gargtycaattaggrataccncaycchgcrggdn

SEQ ID NO: 540 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 100 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
cargayttytgggargtycarttaggrataccdcayccagcagggn

SEQ ID NO: 541 - DNA, 36 bp, Artificial Sequence; identical to SEQ ID NO: 527
  Pan degenerate oligonucleotide primer
  primer_bind (1)..(36)
  modified_base (1)..(1): base is a locked nucleic acid
  modified_base (4)..(4): base is a locked nucleic acid
  modified_base (8)..(8): base is a locked nucleic acid
  misc_feature (24)..(24): n is a, c, g, or t
  misc_feature (30)..(36): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 542 - DNA, 36 bp, Artificial Sequence; identical to SEQ ID NO: 527
  Pan degenerate oligonucleotide primer
  primer_bind (1)..(36)
  modified_base (1)..(1): base is a locked nucleic acid
  modified_base (5)..(5): base is a locked nucleic acid
  modified_base (8)..(8): base is a locked nucleic acid
  misc_feature (24)..(24): n is a, c, g, or t
  misc_feature (30)..(36): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 543 - DNA, 36 bp, Artificial Sequence; identical to SEQ ID NO: 527
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (24)..(24): n is a, c, g, or t
  misc_feature (30)..(36): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 544 - DNA, 38 bp, Artificial Sequence; identical to SEQ ID NO: 528
  Pan degenerate oligonucleotide primer
  primer_bind (1)..(38)
  modified_base (1)..(1): base is a locked nucleic acid
  modified_base (3)..(3): base is a locked nucleic acid
  modified_base (7)..(7): base is a locked nucleic acid
  misc_feature (26)..(26): n is a, c, g, or t
  misc_feature (32)..(38): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 545 - DNA, 38 bp, Artificial Sequence; identical to SEQ ID NO: 528
  Pan degenerate oligonucleotide primer
  primer_bind (1)..(38)
  modified_base (1)..(1): base is a locked nucleic acid
  modified_base (6)..(6): base is a locked nucleic acid
  modified_base (7)..(7): base is a locked nucleic acid
  misc_feature (26)..(26): n is a, c, g, or t
  misc_feature (32)..(38): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 546 - DNA, 38 bp, Artificial Sequence; identical to SEQ ID NO: 528
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (26)..(26): n is a, c, g, or t
  misc_feature (32)..(38): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 547 - DNA, 40 bp, Artificial Sequence; identical to SEQ ID NO: 529
  Pan degenerate oligonucleotide primer
  primer_bind (1)..(40)
  modified_base (2)..(2): base is a locked nucleic acid
  modified_base (3)..(3): base is a locked nucleic acid
  modified_base (8)..(8): base is a locked nucleic acid
  misc_feature (28)..(28): n is a, c, g, or t
  misc_feature (34)..(40): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 548 - DNA, 40 bp, Artificial Sequence; identical to SEQ ID NO: 529
  Pan degenerate oligonucleotide primer
  primer_bind (1)..(40)
  modified_base (2)..(2): base is a locked nucleic acid
  modified_base (5)..(5): base is a locked nucleic acid
  modified_base (8)..(8): base is a locked nucleic acid
  misc_feature (28)..(28): n is a, c, g, or t
  misc_feature (34)..(40): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 549 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (7)..(7): base is a locked nucleic acid
  misc_feature (17)..(17): n is a, c, g, or t
  misc_feature (23)..(29): Adaptor region of the pan degenerate sense primer that adapts the probe-binding site upstream of codon 100 to correspond to the nucleotides in an oligonucleotide probe upstream of the discriminating single nucleotide polymorphism.
tycaattaggrataccncaycchgcrggd

SEQ ID NO: 550 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (17)..(17): n is a, c, g, or t
  misc_feature (23)..(29): Adaptor region of the pan degenerate sense primer that adapts the probe-binding site upstream of codon 100 to correspond to the nucleotides in an oligonucleotide probe upstream of the discriminating single nucleotide polymorphism.
tycaattaggrataccncaycchgcrggd

SEQ ID NO: 551 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (17)..(17): n is a, c, g, or t
  misc_feature (23)..(29): Adaptor region of the pan degenerate sense primer that adapts the probe-binding site upstream of codon 100 to correspond to the nucleotides in an oligonucleotide probe upstream of the discriminating single nucleotide polymorphism.
tycaattaggrataccncaycchgcrggd

SEQ ID NO: 552 - DNA, 32 bp, Artificial Sequence; identical to SEQ ID NO: 531
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (20)..(20): n is a, c, g, or t
  misc_feature (26)..(32): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 553 - DNA, 32 bp, Artificial Sequence; identical to SEQ ID NO: 531
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (20)..(20): n is a, c, g, or t
  misc_feature (26)..(32): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 554 - DNA, 32 bp, Artificial Sequence; identical to SEQ ID NO: 531
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (20)..(20): n is a, c, g, or t
  misc_feature (26)..(32): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 555 - DNA, 33 bp, Artificial Sequence; identical to SEQ ID NO: 532
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (21)..(21): n is a, c, g, or t
  misc_feature (27)..(33): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 556 - DNA, 33 bp, Artificial Sequence; identical to SEQ ID NO: 532
  Pan degenerate oligonucleotide primer
  primer_bind (1)..(33)
  modified_base (1)..(1): base is a locked nucleic acid
  modified_base (5)..(5): base is a locked nucleic acid
  modified_base (7)..(7): base is a locked nucleic acid
  misc_feature (21)..(21): n is a, c, g, or t
  misc_feature (27)..(33): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 557 - DNA, 33 bp, Artificial Sequence; identical to SEQ ID NO: 532
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (21)..(21): n is a, c, g, or t
  misc_feature (27)..(33): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 558 - DNA, 40 bp, Artificial Sequence; identical to SEQ ID NO: 529
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (28)..(28): n is a, c, g, or t
  misc_feature (34)..(40): Adaptor region of the pan degenerate sense primer that adapts the probe-binding site upstream of codon 100 to correspond to the nucleotides in an oligonucleotide probe upstream of the discriminating single nucleotide polymorphism.

SEQ ID NO: 559 - DNA, 35 bp, Artificial Sequence
  Pan degenerate oligonucleotide primer
  primer_bind (1)..(35)
  misc_feature (20)..(20): n is a, c, g, or t
  misc_feature (29)..(35): Adaptor region of the pan degenerate sense primer that adapts the probe-binding site upstream of codon 101 to correspond to the nucleotides in an oligonucleotide probe upstream of the discriminating single nucleotide polymorphism.
argtycaattaggrataccncaycchgcrggdyta

SEQ ID NO: 560 - DNA, 36 bp, Artificial Sequence
  Pan degenerate oligonucleotide primer
  primer_bind (1)..(36)
  misc_feature (21)..(21): n is a, c, g, or t
  misc_feature (30)..(36): Adaptor region of the pan degenerate sense primer that adapts the probe-binding site upstream of codon 101 to correspond to the nucleotides in an oligonucleotide probe upstream of the discriminating single nucleotide polymorphism.
gargtycaattaggrataccncaycchgcrggdyta

SEQ ID NO: 561 - DNA, 40 bp, Artificial Sequence
  Pan degenerate oligonucleotide primer
  primer_bind (1)..(40)
  misc_feature (25)..(25): n is a, c, g, or t
  misc_feature (34)..(40): Adaptor region of the pan degenerate sense primer that adapts the probe-binding site upstream of codon 101 to correspond to the nucleotides in an oligonucleotide probe upstream of the discriminating single nucleotide polymorphism.
ytgggargtycaattaggrataccncaycchgcrggdyta

SEQ ID NO: 562 - DNA, 29 bp, Artificial Sequence
  Pan degenerate oligonucleotide primer
  primer_bind (1)..(29)
  misc_feature (14)..(14): n is a, c, g, or t
  misc_feature (23)..(29): Adaptor region of the pan degenerate sense primer that adapts the probe-binding site upstream of codon 101 to correspond to the nucleotides in an oligonucleotide probe upstream of the discriminating single nucleotide polymorphism.
aattaggrataccncaycchgcrggdyta

SEQ ID NO: 563 - DNA, 30 bp, Artificial Sequence
  Pan degenerate oligonucleotide primer
  primer_bind (1)..(30)
  misc_feature (15)..(15): n is a, c, g, or t
  misc_feature (24)..(30): Adaptor region of the pan degenerate sense primer that adapts the probe-binding site upstream of codon 101 to correspond to the nucleotides in an oligonucleotide probe upstream of the discriminating single nucleotide polymorphism.
caattaggrataccncaycchgcrggdyta

SEQ ID NO: 564 - DNA, 32 bp, Artificial Sequence
  Pan degenerate oligonucleotide primer
  primer_bind (1)..(32)
  misc_feature (17)..(17): n is a, c, g, or t
  misc_feature (26)..(32): Adaptor region of the pan degenerate sense primer that adapts the probe-binding site upstream of codon 101 to correspond to the nucleotides in an oligonucleotide probe upstream of the discriminating single nucleotide polymorphism.
tycaattaggrataccncaycchgcrggdyta

SEQ ID NO: 565 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 101 to correspond to the nucleotides in an oligonucleotide probe upstream of the discriminating single nucleotide polymorphism.
gayttytgggargtycarttaggrataccdcaycchgcrgggtta

SEQ ID NO: 566 - DNA, 36 bp, Artificial Sequence
  Pan degenerate oligonucleotide primer
  primer_bind (1)..(36)
  misc_feature (20)..(20): n is a, c, g, or t
  misc_feature (29)..(35): Adaptor region of the pan degenerate sense primer that adapts the probe-binding site upstream of codon 101 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
argtycaattaggrataccncaycchgcrggdytan

SEQ ID NO: 567 - DNA, 37 bp, Artificial Sequence
  Pan degenerate oligonucleotide primer
  primer_bind (1)..(37)
  misc_feature (21)..(21): n is a, c, g, or t
  misc_feature (30)..(36): Adaptor region of the pan degenerate sense primer that adapts the probe-binding site upstream of codon 101 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
gargtycaattaggrataccncaycchgcrggdytan

SEQ ID NO: 568 - DNA, 41 bp, Artificial Sequence
  Pan degenerate oligonucleotide primer
  primer_bind (1)..(41)
  misc_feature (25)..(25): n is a, c, g, or t
  misc_feature (34)..(40): Adaptor region of the pan degenerate sense primer that adapts the probe-binding site upstream of codon 101 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ytgggargtycaattaggrataccncaycchgcrggdytan

SEQ ID NO: 569 - DNA, 30 bp, Artificial Sequence
  Pan degenerate oligonucleotide primer
  primer_bind (1)..(30)
  misc_feature (14)..(14): n is a, c, g, or t
  misc_feature (23)..(29): Adaptor region of the pan degenerate sense primer that adapts the probe-binding site upstream of codon 101 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
aattaggrataccncaycchgcrggdytan

SEQ ID NO: 570 - DNA, 31 bp, Artificial Sequence
  Pan degenerate oligonucleotide primer
  primer_bind (1)..(31)
  misc_feature (15)..(15): n is a, c, g, or t
  misc_feature (24)..(30): Adaptor region of the pan degenerate sense primer that adapts the probe-binding site upstream of codon 101 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
caattaggrataccncaycchgcrggdytan

SEQ ID NO: 571 - DNA, 33 bp, Artificial Sequence
  Pan degenerate oligonucleotide primer
  primer_bind (1)..(33)
  misc_feature (17)..(17): n is a, c, g, or t
  misc_feature (26)..(32): Adaptor region of the pan degenerate sense primer that adapts the probe-binding site upstream of codon 101 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
tycaattaggrataccncaycchgcrggdytan

SEQ ID NO: 572 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 101 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
gayttytgggargtycarttaggrataccdcaycchgcrgggttan

SEQ ID NO: 573 - DNA, 35 bp, Artificial Sequence; identical to SEQ ID NO: 559
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (20)..(20): n is a, c, g, or t
  misc_feature (29)..(35): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 574 - DNA, 35 bp, Artificial Sequence; identical to SEQ ID NO: 559
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (20)..(20): n is a, c, g, or t
  misc_feature (29)..(35): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 575 - DNA, 35 bp, Artificial Sequence; identical to SEQ ID NO: 559
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (20)..(20): n is a, c, g, or t
  misc_feature (29)..(35): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 576 - DNA, 36 bp, Artificial Sequence; identical to SEQ ID NO: 560
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (21)..(21): n is a, c, g, or t
  misc_feature (30)..(36): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 577 - DNA, 36 bp, Artificial Sequence; identical to SEQ ID NO: 560
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (21)..(21): n is a, c, g, or t
  misc_feature (30)..(36): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 578 - DNA, 36 bp, Artificial Sequence; identical to SEQ ID NO: 560
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (21)..(21): n is a, c, g, or t
  misc_feature (30)..(36): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 579 - DNA, 40 bp, Artificial Sequence; identical to SEQ ID NO: 561
  Pan degenerate oligonucleotide primer
  primer_bind (1)..(40)
  modified_base (2)..(2): base is a locked nucleic acid
  modified_base (5)..(5): base is a locked nucleic acid
  modified_base (9)..(9): base is a locked nucleic acid
  misc_feature (25)..(25): n is a, c, g, or t
  misc_feature (34)..(40): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 580 - DNA, 40 bp, Artificial Sequence; identical to SEQ ID NO: 561
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (25)..(25): n is a, c, g, or t
  misc_feature (34)..(40): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 581 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (14)..(14): n is a, c, g, or t
  misc_feature (23)..(29): Adaptor region of the pan degenerate sense primer that adapts the probe-binding site upstream of codon 101 to correspond to the nucleotides in an oligonucleotide probe upstream of the discriminating single nucleotide polymorphism.
aattaggrataccncaycchgcrggdyta

SEQ ID NO: 582 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (14)..(14): n is a, c, g, or t
  misc_feature (23)..(29): Adaptor region of the pan degenerate sense primer that adapts the probe-binding site upstream of codon 101 to correspond to the nucleotides in an oligonucleotide probe upstream of the discriminating single nucleotide polymorphism.
aattaggrataccncaycchgcrggdyta

SEQ ID NO: 583 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (14)..(14): n is a, c, g, or t
  misc_feature (23)..(29): Adaptor region of the pan degenerate sense primer that adapts the probe-binding site upstream of codon 101 to correspond to the nucleotides in an oligonucleotide probe upstream of the discriminating single nucleotide polymorphism.
aattaggrataccncaycchgcrggdyta

SEQ ID NO: 584 - DNA, 30 bp, Artificial Sequence; identical to SEQ ID NO: 563
  Pan degenerate oligonucleotide primer
  primer_bind (1)..(30)
  modified_base (1)..(1): base is a locked nucleic acid
  modified_base (2)..(2): base is a locked nucleic acid
  modified_base (7)..(7): base is a locked nucleic acid
  misc_feature (15)..(15): n is a, c, g, or t
  misc_feature (24)..(30): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 585 - DNA, 30 bp, Artificial Sequence; identical to SEQ ID NO: 563
  Pan degenerate oligonucleotide primer
  primer_bind (1)..(30)
  modified_base (1)..(1): base is a locked nucleic acid
  modified_base (5)..(5): base is a locked nucleic acid
  modified_base (7)..(7): base is a locked nucleic acid
  misc_feature (15)..(15): n is a, c, g, or t
  misc_feature (24)..(30): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 586 - DNA, 30 bp, Artificial Sequence; identical to SEQ ID NO: 563
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (15)..(15): n is a, c, g, or t
  misc_feature (24)..(30): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 587 - DNA, 32 bp, Artificial Sequence; identical to SEQ ID NO: 564
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (17)..(17): n is a, c, g, or t
  misc_feature (26)..(32): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 588 - DNA, 32 bp, Artificial Sequence; identical to SEQ ID NO: 564
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (17)..(17): n is a, c, g, or t
  misc_feature (26)..(32): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 589 - DNA, 32 bp, Artificial Sequence; identical to SEQ ID NO: 564
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (17)..(17): n is a, c, g, or t
  misc_feature (26)..(32): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 590 - DNA, 40 bp, Artificial Sequence; identical to SEQ ID NO: 561
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (25)..(25): n is a, c, g, or t
  misc_feature (34)..(40): Adaptor region of the pan degenerate sense primer that adapts the probe-binding site upstream of codon 101 to correspond to the nucleotides in an oligonucleotide probe upstream of the discriminating single nucleotide polymorphism.

SEQ ID NO: 591 - DNA, 37 bp, Artificial Sequence
  Pan degenerate oligonucleotide primer
  primer_bind (1)..(37)
  misc_feature (14)..(14): n is a, c, g, or t
  misc_feature (31)..(37): Adaptor region of the pan degenerate sense primer that adapts the probe-binding site upstream of codon 103 to correspond to the nucleotides in an oligonucleotide probe upstream of the discriminating single nucleotide polymorphism.
aattaggrataccncaycchgcrggdytaaaaaagaa

SEQ ID NO: 592 - DNA, 38 bp, Artificial Sequence
  Pan degenerate oligonucleotide primer
  primer_bind (1)..(38)
  misc_feature (15)..(15): n is a, c, g, or t
  misc_feature (32)..(38): Adaptor region of the pan degenerate sense primer that adapts the probe-binding site upstream of codon 103 to correspond to the nucleotides in an oligonucleotide probe upstream of the discriminating single nucleotide polymorphism.
caattaggrataccncaycchgcrggdytaaaaaagaa

SEQ ID NO: 593 - DNA, 40 bp, Artificial Sequence
  Pan degenerate oligonucleotide primer
  primer_bind (1)..(40)
  misc_feature (17)..(17): n is a, c, g, or t
  misc_feature (34)..(40): Adaptor region of the pan degenerate sense primer that adapts the probe-binding site upstream of codon 103 to correspond to the nucleotides in an oligonucleotide probe upstream of the discriminating single nucleotide polymorphism.
tycaattaggrataccncaycchgcrggdytaaaaaagaa

SEQ ID NO: 594 - DNA, 31 bp, Artificial Sequence
  Pan degenerate oligonucleotide primer
  primer_bind (1)..(31)
  misc_feature (8)..(8): n is a, c, g, or t
  misc_feature (25)..(31): Adaptor region of the pan degenerate sense primer that adapts the probe-binding site upstream of codon 103 to correspond to the nucleotides in an oligonucleotide probe upstream of the discriminating single nucleotide polymorphism.
grataccncaycchgcrggdytaaaaaagaa

SEQ ID NO: 595 - DNA, 32 bp, Artificial Sequence
  Pan degenerate oligonucleotide primer
  primer_bind (1)..(32)
  misc_feature (9)..(9): n is a, c, g, or t
  misc_feature (26)..(32): Adaptor region of the pan degenerate sense primer that adapts the probe-binding site upstream of codon 103 to correspond to the nucleotides in an oligonucleotide probe upstream of the discriminating single nucleotide polymorphism.
ggrataccncaycchgcrggdytaaaaaagaa

SEQ ID NO: 596 - DNA, 34 bp, Artificial Sequence
  Pan degenerate oligonucleotide primer
  primer_bind (1)..(34)
  misc_feature (11)..(11): n is a, c, g, or t
  misc_feature (28)..(34): Adaptor region of the pan degenerate sense primer that adapts the probe-binding site upstream of codon 103 to correspond to the nucleotides in an oligonucleotide probe upstream of the discriminating single nucleotide polymorphism.
taggrataccncaycchgcrggdytaaaaaagaa

SEQ ID NO: 597 - DNA, 44 bp, Artificial Sequence
  Pan degenerate oligonucleotide primer
  primer_bind (1)..(44)
  misc_feature (38)..(44): Adaptor region of the pan degenerate sense primer that adapts the probe-binding site upstream of codon 103 to correspond to the nucleotides in an oligonucleotide probe upstream of the discriminating single nucleotide polymorphism.
tgggargtycarttaggrataccdcaycchgcrggdytaaaaag

SEQ ID NO: 598 - DNA, 38 bp, Artificial Sequence
  Pan degenerate oligonucleotide primer
  primer_bind (1)..(38)
  misc_feature (14)..(14): n is a, c, g, or t
  misc_feature (31)..(37): Adaptor region of the pan degenerate sense primer that adapts the probe-binding site upstream of codon 103 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
aattaggrataccncaycchgcrggdytaaaaaagaan

SEQ ID NO: 599 - DNA, 39 bp, Artificial Sequence
  Pan degenerate oligonucleotide primer
  primer_bind (1)..(39)
  misc_feature (15)..(15): n is a, c, g, or t
  misc_feature (32)..(38): Adaptor region of the pan degenerate sense primer that adapts the probe-binding site upstream of codon 103 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
caattaggrataccncaycchgcrggdytaaaaaagaan

SEQ ID NO: 600 - DNA, 41 bp, Artificial Sequence
  Pan degenerate oligonucleotide primer
  primer_bind (1)..(41)
  misc_feature (17)..(17): n is a, c, g, or t
  misc_feature (34)..(40): Adaptor region of the pan degenerate sense primer that adapts the probe-binding site upstream of codon 103 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
tycaattaggrataccncaycchgcrggdytaaaaaagaan

SEQ ID NO: 601 - DNA, 32 bp, Artificial Sequence
  Pan degenerate oligonucleotide primer
  primer_bind (1)..(32)
  misc_feature (8)..(8): n is a, c, g, or t
  misc_feature (25)..(31): Adaptor region of the pan degenerate sense primer that adapts the probe-binding site upstream of codon 103 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
grataccncaycchgcrggdytaaaaaagaan

SEQ ID NO: 602 - DNA, 33 bp, Artificial Sequence
  Pan degenerate oligonucleotide primer
  primer_bind (1)..(33)
  misc_feature (9)..(9): n is a, c, g, or t
  misc_feature (26)..(32): Adaptor region of the pan degenerate sense primer that adapts the probe-binding site upstream of codon 103 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
ggrataccncaycchgcrggdytaaaaaagaan

SEQ ID NO: 603 - DNA, 35 bp, Artificial Sequence
  Pan degenerate oligonucleotide primer
  primer_bind (1)..(35)
  misc_feature (11)..(11): n is a, c, g, or t
  misc_feature (28)..(34): Adaptor region of the pan degenerate sense primer that adapts the probe-binding site upstream of codon 103 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
taggrataccncaycchgcrggdytaaaaaagaan

SEQ ID NO: 604 - DNA, 45 bp, Artificial Sequence
  Pan degenerate oligonucleotide primer
  primer_bind (1)..(45)
  misc_feature (38)..(44): Adaptor region of the pan degenerate sense primer that adapts the probe-binding site upstream of codon 103 to correspond to the nucleotides in an oligonucleotide probe upstream of the discriminating single nucleotide polymorphism.
  modified_base (45)..(45): base is a locked nucleic acid
  misc_feature (45)..(45): n is a, c, g, or t
tgggargtycarttaggrataccdcaycchgcrggdytaaaaagn

SEQ ID NO: 605 - DNA, 37 bp, Artificial Sequence; identical to SEQ ID NO: 591
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (14)..(14): n is a, c, g, or t
  misc_feature (31)..(37): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 606 - DNA, 37 bp, Artificial Sequence; identical to SEQ ID NO: 591
  Pan degenerate oligonucleotide primer
  primer_bind (1)..(37)
  modified_base (1)..(1): base is a locked nucleic acid
  modified_base (6)..(6): base is a locked nucleic acid
  modified_base (7)..(7): base is a locked nucleic acid
  misc_feature (14)..(14): n is a, c, g, or t
  misc_feature (31)..(37): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 607 - DNA, 37 bp, Artificial Sequence; identical to SEQ ID NO: 591
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (14)..(14): n is a, c, g, or t
  misc_feature (31)..(37): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 608 - DNA, 38 bp, Artificial Sequence; identical to SEQ ID NO: 592
  Pan degenerate oligonucleotide primer
  primer_bind (1)..(38)
  modified_base (1)..(1): base is a locked nucleic acid
  modified_base (2)..(2): base is a locked nucleic acid
  modified_base (7)..(7): base is a locked nucleic acid
  misc_feature (15)..(15): n is a, c, g, or t
  misc_feature (32)..(38): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 609 - DNA, 38 bp, Artificial Sequence; identical to SEQ ID NO: 592
  Pan degenerate oligonucleotide primer
  primer_bind (1)..(38)
  modified_base (1)..(1): base is a locked nucleic acid
  modified_base (5)..(5): base is a locked nucleic acid
  modified_base (7)..(7): base is a locked nucleic acid
  misc_feature (15)..(15): n is a, c, g, or t
  misc_feature (32)..(38): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 610 - DNA, 38 bp, Artificial Sequence; identical to SEQ ID NO: 592
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (15)..(15): n is a, c, g, or t
  misc_feature (32)..(38): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 611 - DNA, 40 bp, Artificial Sequence; identical to SEQ ID NO: 593
  Pan degenerate oligonucleotide primer
  primer_bind (1)..(40)
  modified_base (1)..(1): base is a locked nucleic acid
  modified_base (3)..(3): base is a locked nucleic acid
  modified_base (7)..(7): base is a locked nucleic acid
  misc_feature (17)..(17): n is a, c, g, or t
  misc_feature (34)..(40): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 612 - DNA, 40 bp, Artificial Sequence; identical to SEQ ID NO: 593
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (17)..(17): n is a, c, g, or t
  misc_feature (34)..(40): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 613 - DNA, 31 bp, Artificial Sequence; identical to SEQ ID NO: 594
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (8)..(8): n is a, c, g, or t
  misc_feature (25)..(31): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 614 - DNA, 31 bp, Artificial Sequence; identical to SEQ ID NO: 594
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (8)..(8): n is a, c, g, or t
  misc_feature (25)..(31): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 615 - DNA, 31 bp, Artificial Sequence; identical to SEQ ID NO: 594
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (8)..(8): n is a, c, g, or t
  misc_feature (25)..(31): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 616 - DNA, 32 bp, Artificial Sequence; identical to SEQ ID NO: 595
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (9)..(9): n is a, c, g, or t
  misc_feature (26)..(32): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 617 - DNA, 32 bp, Artificial Sequence; identical to SEQ ID NO: 595
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (9)..(9): n is a, c, g, or t
  misc_feature (26)..(32): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 618 - DNA, 32 bp, Artificial Sequence; identical to SEQ ID NO: 595
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (9)..(9): n is a, c, g, or t
  misc_feature (26)..(32): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 619 - DNA, 34 bp, Artificial Sequence; identical to SEQ ID NO: 596
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (11)..(11): n is a, c, g, or t
  misc_feature (28)..(34): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 620 - DNA, 34 bp, Artificial Sequence; identical to SEQ ID NO: 596
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (11)..(11): n is a, c, g, or t
  misc_feature (28)..(34): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 621 - DNA, 34 bp, Artificial Sequence; identical to SEQ ID NO: 596
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (11)..(11): n is a, c, g, or t
  misc_feature (28)..(34): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 622 - DNA, 40 bp, Artificial Sequence; identical to SEQ ID NO: 593
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (17)..(17): n is a, c, g, or t
  misc_feature (34)..(40): Adaptor region of the pan degenerate sense primer that adapts the probe-binding site upstream of codon 103 to correspond to the nucleotides in an oligonucleotide probe upstream of the discriminating single nucleotide polymorphism.

SEQ ID NO: 623 - DNA, 37 bp, Artificial Sequence
  Pan degenerate oligonucleotide primer
  primer_bind (1)..(37)
  misc_feature (6)..(6): n is a, c, g, or t
  misc_feature (31)..(37): Adaptor region of the pan degenerate sense primer that adapts the probe-binding site upstream of codon 106 to correspond to the nucleotides in an oligonucleotide probe upstream of the discriminating single nucleotide polymorphism.
ataccncaycchgcrggdytaaaaaagaamaaatcag

SEQ ID NO: 624 - DNA, 39 bp, Artificial Sequence
  Pan degenerate oligonucleotide primer
  primer_bind (1)..(39)
  misc_feature (8)..(8): n is a, c, g, or t
  misc_feature (33)..(39): Adaptor region of the pan degenerate sense primer that adapts the probe-binding site upstream of codon 106 to correspond to the nucleotides in an oligonucleotide probe upstream of the discriminating single nucleotide polymorphism.
grataccncaycchgcrggdytaaaaaagaamaaatcag

SEQ ID NO: 625 - DNA, 40 bp, Artificial Sequence
  Pan degenerate oligonucleotide primer
  primer_bind (1)..(40)
  misc_feature (9)..(9): n is a, c, g, or t
  misc_feature (34)..(40): Adaptor region of the pan degenerate sense primer that adapts the probe-binding site upstream of codon 106 to correspond to the nucleotides in an oligonucleotide probe upstream of the discriminating single nucleotide polymorphism.
ggrataccncaycchgcrggdytaaaaaagaamaaatcag

SEQ ID NO: 626 - DNA, 33 bp, Artificial Sequence
  Pan degenerate oligonucleotide primer
  primer_bind (1)..(33)
  misc_feature (2)..(2): n is a, c, g, or t
  misc_feature (27)..(33): Adaptor region of the pan degenerate sense primer that adapts the probe-binding site upstream of codon 106 to correspond to the nucleotides in an oligonucleotide probe upstream of the discriminating single nucleotide polymorphism.
cncaycchgcrggdytaaaaaagaamaaatcag

SEQ ID NO: 627 - DNA, 34 bp, Artificial Sequence
  Pan degenerate oligonucleotide primer
  primer_bind (1)..(34)
  misc_feature (3)..(3): n is a, c, g, or t
  misc_feature (28)..(34): Adaptor region of the pan degenerate sense primer that adapts the probe-binding site upstream of codon 106 to correspond to the nucleotides in an oligonucleotide probe upstream of the discriminating single nucleotide polymorphism.
ccncaycchgcrggdytaaaaaagaamaaatcag

SEQ ID NO: 628 - DNA, 36 bp, Artificial Sequence
  Pan degenerate oligonucleotide primer
  primer_bind (1)..(36)
  misc_feature (5)..(5): n is a, c, g, or t
  misc_feature (30)..(36): Adaptor region of the pan degenerate sense primer that adapts the probe-binding site upstream of codon 106 to correspond to the nucleotides in an oligonucleotide probe upstream of the discriminating single nucleotide polymorphism.
taccncaycchgcrggdytaaaaaagaamaaatcag

SEQ ID NO: 629 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 106 to correspond to the nucleotides in an oligonucleotide probe upstream of the discriminating single nucleotide polymorphism.
carttaggrataccdcaycchgcrggdytaaaraagaaraaatca

SEQ ID NO: 630 - DNA, 38 bp, Artificial Sequence
  Pan degenerate oligonucleotide primer
  primer_bind (1)..(38)
  misc_feature (6)..(6): n is a, c, g, or t
  misc_feature (31)..(37): Adaptor region of the pan degenerate sense primer that adapts the probe-binding site upstream of codon 106 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ataccncaycchgcrggdytaaaaaagaamaaatcagn

SEQ ID NO: 631 - DNA, 40 bp, Artificial Sequence
  Pan degenerate oligonucleotide primer
  primer_bind (1)..(40)
  misc_feature (8)..(8): n is a, c, g, or t
  misc_feature (33)..(39): Adaptor region of the pan degenerate sense primer that adapts the probe-binding site upstream of codon 106 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
grataccncaycchgcrggdytaaaaaagaamaaatcagn

SEQ ID NO: 632 - DNA, 41 bp, Artificial Sequence
  Pan degenerate oligonucleotide primer
  primer_bind (1)..(41)
  misc_feature (9)..(9): n is a, c, g, or t
  misc_feature (34)..(40): Adaptor region of the pan degenerate sense primer that adapts the probe-binding site upstream of codon 106 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ggrataccncaycchgcrggdytaaaaaagaamaaatcagn

SEQ ID NO: 633 - DNA, 34 bp, Artificial Sequence
  Pan degenerate oligonucleotide primer
  primer_bind (1)..(34)
  misc_feature (2)..(2): n is a, c, g, or t
  misc_feature (27)..(33): Adaptor region of the pan degenerate sense primer that adapts the probe-binding site upstream of codon 106 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cncaycchgcrggdytaaaaaagaamaaatcagn

SEQ ID NO: 634 - DNA, 35 bp, Artificial Sequence
  Pan degenerate oligonucleotide primer
  primer_bind (1)..(35)
  misc_feature (3)..(3): n is a, c, g, or t
  misc_feature (28)..(34): Adaptor region of the pan degenerate sense primer that adapts the probe-binding site upstream of codon 106 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ccncaycchgcrggdytaaaaaagaamaaatcagn

SEQ ID NO: 635 - DNA, 37 bp, Artificial Sequence
  Pan degenerate oligonucleotide primer
  primer_bind (1)..(37)
  misc_feature (5)..(5): n is a, c, g, or t
  misc_feature (30)..(36): Adaptor region of the pan degenerate sense primer that adapts the probe-binding site upstream of codon 106 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
taccncaycchgcrggdytaaaaaagaamaaatcagn

SEQ ID NO: 636 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 106 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
carttaggrataccdcaycchgcrggdytaaaraagaaraaatcan

SEQ ID NO: 637 - DNA, 37 bp, Artificial Sequence; identical to SEQ ID NO: 623
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (6)..(6): n is a, c, g, or t
  misc_feature (31)..(37): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 638 - DNA, 37 bp, Artificial Sequence; identical to SEQ ID NO: 623
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (6)..(6): n is a, c, g, or t
  misc_feature (31)..(37): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 639 - DNA, 37 bp, Artificial Sequence; identical to SEQ ID NO: 623
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (6)..(6): n is a, c, g, or t
  misc_feature (31)..(37): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 640 - DNA, 39 bp, Artificial Sequence; identical to SEQ ID NO: 624
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (8)..(8): n is a, c, g, or t
  misc_feature (33)..(39): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 641 - DNA, 39 bp, Artificial Sequence; identical to SEQ ID NO: 624
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (8)..(8): n is a, c, g, or t
  misc_feature (33)..(39): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 642 - DNA, 39 bp, Artificial Sequence; identical to SEQ ID NO: 624
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (8)..(8): n is a, c, g, or t
  misc_feature (33)..(39): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 643 - DNA, 40 bp, Artificial Sequence; identical to SEQ ID NO: 625
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (9)..(9): n is a, c, g, or t
  misc_feature (34)..(40): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 644 - DNA, 40 bp, Artificial Sequence; identical to SEQ ID NO: 625
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (9)..(9): n is a, c, g, or t
  misc_feature (34)..(40): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 645 - DNA, 33 bp, Artificial Sequence; identical to SEQ ID NO: 626
  Pan degenerate oligonucleotide primer
  primer_bind (1)..(33)
  modified_base (1)..(1): base is a locked nucleic acid
  misc_feature (2)..(2): n is a, c, g, or t
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 646 - DNA, 33 bp, Artificial Sequence; identical to SEQ ID NO: 626
  Pan degenerate oligonucleotide primer
  primer_bind (1)..(33)
  modified_base (1)..(1): base is a locked nucleic acid
  misc_feature (2)..(2): n is a, c, g, or t
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 647 - DNA, 33 bp, Artificial Sequence; identical to SEQ ID NO: 626
  Pan degenerate oligonucleotide primer
  primer_bind (1)..(33)
  modified_base (1)..(1): base is a locked nucleic acid
  misc_feature (2)..(2): n is a, c, g, or t
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 648 - DNA, 34 bp, Artificial Sequence; identical to SEQ ID NO: 627
  Pan degenerate oligonucleotide primer
  primer_bind (1)..(34)
  modified_base (1)..(1): base is a locked nucleic acid
  modified_base (2)..(2): base is a locked nucleic acid
  misc_feature (3)..(3): n is a, c, g, or t
  modified_base (5)..(5): base is a locked nucleic acid
  misc_feature (28)..(34): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 649 - DNA, 34 bp, Artificial Sequence; identical to SEQ ID NO: 627
  Pan degenerate oligonucleotide primer
  primer_bind (1)..(34)
  modified_base (1)..(1): base is a locked nucleic acid
  misc_feature (3)..(3): n is a, c, g, or t
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 650 - DNA, 34 bp, Artificial Sequence; identical to SEQ ID NO: 627
  Pan degenerate oligonucleotide primer
  primer_bind (1)..(34)
  modified_base (1)..(1): base is a locked nucleic acid
  modified_base (2)..(2): base is a locked nucleic acid
  misc_feature (3)..(3): n is a, c, g, or t
  modified_base (4)..(4): base is a locked nucleic acid
  misc_feature (28)..(34): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 651 - DNA, 36 bp, Artificial Sequence; identical to SEQ ID NO: 628
  Pan degenerate oligonucleotide primer
  primer_bind (1)..(36)
  modified_base (1)..(1): base is a locked nucleic acid
  modified_base (3)..(3): base is a locked nucleic acid
  misc_feature (5)..(5): n is a, c, g, or t
  modified_base (6)..(6): base is a locked nucleic acid
  misc_feature (30)..(36): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 652 - DNA, 36 bp, Artificial Sequence; identical to SEQ ID NO: 628
  Pan degenerate oligonucleotide primer
  primer_bind (1)..(36)
  modified_base (1)..(1): base is a locked nucleic acid
  modified_base (4)..(4): base is a locked nucleic acid
  misc_feature (5)..(5): n is a, c, g, or t
  modified_base (6)..(6): base is a locked nucleic acid
  misc_feature (30)..(36): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 653 - DNA, 36 bp, Artificial Sequence; identical to SEQ ID NO: 628
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (5)..(5): n is a, c, g, or t
  misc_feature (30)..(36): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 654 - DNA, 40 bp, Artificial Sequence; identical to SEQ ID NO: 625
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (9)..(9): n is a, c, g, or t
  misc_feature (34)..(40): Adaptor region of the pan degenerate sense primer that adapts the probe-binding site upstream of codon 106 to correspond to the nucleotides in an oligonucleotide probe upstream of the discriminating single nucleotide polymorphism.

SEQ ID NO: 655 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 108 to correspond to the nucleotides in an oligonucleotide probe upstream of the discriminating single nucleotide polymorphism.
caycchgcrggdytaaaaaagaamaaatcagtraca

SEQ ID NO: 656 - DNA, 38 bp, Artificial Sequence
  Pan degenerate oligonucleotide primer
  primer_bind (1)..(38)
  misc_feature (2)..(2): n is a, c, g, or t
  misc_feature (32)..(38): Adaptor region of the pan degenerate sense primer that adapts the probe-binding site upstream of codon 108 to correspond to the nucleotides in an oligonucleotide probe upstream of the discriminating single nucleotide polymorphism.
cncaycchgcrggdytaaaaaagaamaaatcagtraca

SEQ ID NO: 657 - DNA, 40 bp, Artificial Sequence
  Pan degenerate oligonucleotide primer
  primer_bind (1)..(40)
  misc_feature (4)..(4): n is a, c, g, or t
  misc_feature (34)..(40): Adaptor region of the pan degenerate sense primer that adapts the probe-binding site upstream of codon 108 to correspond to the nucleotides in an oligonucleotide probe upstream of the discriminating single nucleotide polymorphism.
accncaycchgcrggdytaaaaaagaamaaatcagtraca

SEQ ID NO: 658 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 108 to correspond to the nucleotides in an oligonucleotide probe upstream of the discriminating single nucleotide polymorphism.
chgcrggdytaaaaaagaamaaatcagtraca

SEQ ID NO: 659 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 108 to correspond to the nucleotides in an oligonucleotide probe upstream of the discriminating single nucleotide polymorphism.
cchgcrggdytaaaaaagaamaaatcagtraca

SEQ ID NO: 660 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 108 to correspond to the nucleotides in an oligonucleotide probe upstream of the discriminating single nucleotide polymorphism.
aycchgcrggdytaaaaaagaamaaatcagtraca

SEQ ID NO: 661 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 108 to correspond to the nucleotides in an oligonucleotide probe upstream of the discriminating single nucleotide polymorphism.
ggrataccdcaycchgcrggdytaaaraagaaraartcwgtaaca

SEQ ID NO: 662 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 108 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
caycchgcrggdytaaaaaagaamaaatcagtracan

SEQ ID NO: 663 - DNA, 39 bp, Artificial Sequence
  Pan degenerate oligonucleotide primer
  primer_bind (1)..(39)
  misc_feature (2)..(2): n is a, c, g, or t
  misc_feature (32)..(38): Adaptor region of the pan degenerate sense primer that adapts the probe-binding site upstream of codon 108 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
cncaycchgcrggdytaaaaaagaamaaatcagtracan

SEQ ID NO: 664 - DNA, 41 bp, Artificial Sequence
  Pan degenerate oligonucleotide primer
  primer_bind (1)..(41)
  misc_feature (4)..(4): n is a, c, g, or t
  misc_feature (34)..(40): Adaptor region of the pan degenerate sense primer that adapts the probe-binding site upstream of codon 108 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
accncaycchgcrggdytaaaaaagaamaaatcagtracan

SEQ ID NO: 665 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 108 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
chgcrggdytaaaaaagaamaaatcagtracan

SEQ ID NO: 666 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 108 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cchgcrggdytaaaaaagaamaaatcagtracan

SEQ ID NO: 667 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 108 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
aycchgcrggdytaaaaaagaamaaatcagtracan

SEQ ID NO: 668 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 108 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ggrataccdcaycchgcrggdytaaaraagaaraartcwgtaacan

SEQ ID NO: 669 - DNA, 36 bp, Artificial Sequence; identical to SEQ ID NO: 655
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 670 - DNA, 36 bp, Artificial Sequence; identical to SEQ ID NO: 655
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 671 - DNA, 36 bp, Artificial Sequence; identical to SEQ ID NO: 655
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 672 - DNA, 38 bp, Artificial Sequence; identical to SEQ ID NO: 656
  Pan degenerate oligonucleotide primer
  primer_bind (1)..(38)
  modified_base (1)..(1): base is a locked nucleic acid
  misc_feature (2)..(2): n is a, c, g, or t
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 673 - DNA, 38 bp, Artificial Sequence; identical to SEQ ID NO: 656
  Pan degenerate oligonucleotide primer
  primer_bind (1)..(38)
  modified_base (1)..(1): base is a locked nucleic acid
  misc_feature (2)..(2): n is a, c, g, or t
  modified_base (4)..(4): base is a locked nucleic acid
  modified_base (6)..(6): base is a locked nucleic acid
  misc_feature (32)..(38): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 674 - DNA, 38 bp, Artificial Sequence; identical to SEQ ID NO: 656
  Pan degenerate oligonucleotide primer
  primer_bind (1)..(38)
  modified_base (1)..(1): base is a locked nucleic acid
  misc_feature (2)..(2): n is a, c, g, or t
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 675 - DNA, 40 bp, Artificial Sequence; identical to SEQ ID NO: 657
  Pan degenerate oligonucleotide primer
  primer_bind (1)..(40)
  modified_base (2)..(2): base is a locked nucleic acid
  modified_base (3)..(3): base is a locked nucleic acid
  misc_feature (4)..(4): n is a, c, g, or t
  modified_base (6)..(6): base is a locked nucleic acid
  misc_feature (34)..(40): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 676 - DNA, 40 bp, Artificial Sequence; identical to SEQ ID NO: 657
  Pan degenerate oligonucleotide primer
  primer_bind (1)..(40)
  modified_base (2)..(2): base is a locked nucleic acid
  misc_feature (4)..(4): n is a, c, g, or t
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 677 - DNA, 32 bp, Artificial Sequence; identical to SEQ ID NO: 658
  Pan degenerate oligonucleotide primer
  primer_bind (1)..(32)
  modified_base (1)..(1): base is a locked nucleic acid
  modified_base (6)..(6): base is a locked nucleic acid
  modified_base (10)..(10): base is a locked nucleic acid
  misc_feature (26)..(32): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 678 - DNA, 32 bp, Artificial Sequence; identical to SEQ ID NO: 658
  Pan degenerate oligonucleotide primer
  primer_bind (1)..(32)
  modified_base (1)..(1): base is a locked nucleic acid
  modified_base (7)..(7): base is a locked nucleic acid
  modified_base (10)..(10): base is a locked nucleic acid
  misc_feature (26)..(32): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 679 - DNA, 32 bp, Artificial Sequence; identical to SEQ ID NO: 658
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 680 - DNA, 33 bp, Artificial Sequence; identical to SEQ ID NO: 659
  Pan degenerate oligonucleotide primer
  primer_bind (1)..(33)
  modified_base (1)..(1): base is a locked nucleic acid
  modified_base (2)..(2): base is a locked nucleic acid
  modified_base (8)..(8): base is a locked nucleic acid
  misc_feature (27)..(33): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 681 - DNA, 33 bp, Artificial Sequence; identical to SEQ ID NO: 659
  Pan degenerate oligonucleotide primer
  primer_bind (1)..(33)
  modified_base (1)..(1): base is a locked nucleic acid
  modified_base (7)..(7): base is a locked nucleic acid
  modified_base (8)..(8): base is a locked nucleic acid
  misc_feature (27)..(33): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 682 - DNA, 33 bp, Artificial Sequence; identical to SEQ ID NO: 659
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 683 - DNA, 35 bp, Artificial Sequence; identical to SEQ ID NO: 660
  Pan degenerate oligonucleotide primer
  primer_bind (1)..(35)
  modified_base (1)..(1): base is a locked nucleic acid
  modified_base (3)..(3): base is a locked nucleic acid
  modified_base (9)..(9): base is a locked nucleic acid
  misc_feature (29)..(35): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 684 - DNA, 35 bp, Artificial Sequence; identical to SEQ ID NO: 660
  Pan degenerate oligonucleotide primer
  primer_bind (1)..(35)
  modified_base (1)..(1): base is a locked nucleic acid
  modified_base (4)..(4): base is a locked nucleic acid
  modified_base (9)..(9): base is a locked nucleic acid
  misc_feature (29)..(35): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 685 - DNA, 35 bp, Artificial Sequence; identical to SEQ ID NO: 660
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 686 - DNA, 40 bp, Artificial Sequence; identical to SEQ ID NO: 657
  Pan degenerate oligonucleotide primer
  primer_bind (1)..(40)
  modified_base (2)..(2): base is a locked nucleic acid
  modified_base (3)..(3): base is a locked nucleic acid
  misc_feature (4)..(4): n is a, c, g, or t
  modified_base (5)..(5): base is a locked nucleic acid
  misc_feature (34)..(40): Adaptor region of the pan degenerate sense primer that adapts the probe-binding site upstream of codon 108 to correspond to the nucleotides in an oligonucleotide probe upstream of the discriminating single nucleotide polymorphism.

SEQ ID NO: 687 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 115 to correspond to the nucleotides in an oligonucleotide probe upstream of the discriminating single nucleotide polymorphism.
cagtracagtrytrgatgtrggdgaygcat

SEQ ID NO: 688 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 115 to correspond to the nucleotides in an oligonucleotide probe upstream of the discriminating single nucleotide polymorphism.
aaatcagtracagtrytrgatgtrggdgaygcat

SEQ ID NO: 689 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 115 to correspond to the nucleotides in an oligonucleotide probe upstream of the discriminating single nucleotide polymorphism.
aagaamaaatcagtracagtrytrgatgtrggdgaygcat

SEQ ID NO: 690 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 115 to correspond to the nucleotides in an oligonucleotide probe upstream of the discriminating single nucleotide polymorphism.
trytrgatgtrggdgaygcat

SEQ ID NO: 691 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 115 to correspond to the nucleotides in an oligonucleotide probe upstream of the discriminating single nucleotide polymorphism.
cagtrytrgatgtrggdgaygcat

SEQ ID NO: 692 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 115 to correspond to the nucleotides in an oligonucleotide probe upstream of the discriminating single nucleotide polymorphism.
ytaaaraagaaraartcwgtracagtvytrgatgtrggdgatgca

SEQ ID NO: 693 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 115 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
cagtracagtrytrgatgtrggdgaygcatn

SEQ ID NO: 694 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 115 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
aaatcagtracagtrytrgatgtrggdgaygcatn

SEQ ID NO: 695 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 115 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aagaamaaatcagtracagtrytrgatgtrggdgaygcatn

SEQ ID NO: 696 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 115 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
trytrgatgtrggdgaygcatn

SEQ ID NO: 697 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 115 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
cagtrytrgatgtrggdgaygcatn

SEQ ID NO: 698 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 115 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ytaaaraagaaraartcwgtracagtvytrgatgtrggdgatgcan

SEQ ID NO: 699 - DNA, 30 bp, Artificial Sequence; identical to SEQ ID NO: 687
  Pan degenerate oligonucleotide primer
  primer_bind (1)..(30)
  modified_base (1)..(1): base is a locked nucleic acid
  modified_base (7)..(7): base is a locked nucleic acid
  modified_base (13)..(13): base is a locked nucleic acid
  misc_feature (24)..(30): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 700 - DNA, 30 bp, Artificial Sequence; identical to SEQ ID NO: 687
  Pan degenerate oligonucleotide primer
  primer_bind (1)..(30)
  modified_base (1)..(1): base is a locked nucleic acid
  modified_base (10)..(10): base is a locked nucleic acid
  modified_base (13)..(13): base is a locked nucleic acid
  misc_feature (24)..(30): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 701 - DNA, 30 bp, Artificial Sequence; identical to SEQ ID NO: 687
  Pan degenerate oligonucleotide primer
  primer_bind (1)..(30)
  modified_base (1)..(1): base is a locked nucleic acid
  modified_base (7)..(7): base is a locked nucleic acid
  modified_base (10)..(10): base is a locked nucleic acid
  misc_feature (24)..(30): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 702 - DNA, 34 bp, Artificial Sequence; identical to SEQ ID NO: 688
  Pan degenerate oligonucleotide primer
  primer_bind (1)..(34)
  modified_base (1)..(1): base is a locked nucleic acid
  modified_base (5)..(5): base is a locked nucleic acid
  modified_base (14)..(14): base is a locked nucleic acid
  misc_feature (28)..(34): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 703 - DNA, 34 bp, Artificial Sequence; identical to SEQ ID NO: 688
  Pan degenerate oligonucleotide primer
  primer_bind (1)..(34)
  modified_base (1)..(1): base is a locked nucleic acid
  modified_base (11)..(11): base is a locked nucleic acid
  modified_base (14)..(14): base is a locked nucleic acid
  misc_feature (28)..(34): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 704 - DNA, 34 bp, Artificial Sequence; identical to SEQ ID NO: 688
  Pan degenerate oligonucleotide primer
  primer_bind (1)..(34)
  modified_base (1)..(1): base is a locked nucleic acid
  modified_base (5)..(5): base is a locked nucleic acid
  modified_base (11)..(11): base is a locked nucleic acid
  misc_feature (28)..(34): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 705 - DNA, 40 bp, Artificial Sequence; identical to SEQ ID NO: 689
  Pan degenerate oligonucleotide primer
  primer_bind (1)..(40)
  modified_base (4)..(4): base is a locked nucleic acid
  modified_base (7)..(7): base is a locked nucleic acid
  modified_base (17)..(17): base is a locked nucleic acid
  misc_feature (34)..(40): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 706 - DNA, 40 bp, Artificial Sequence; identical to SEQ ID NO: 689
  Pan degenerate oligonucleotide primer
  primer_bind (1)..(40)
  modified_base (4)..(4): base is a locked nucleic acid
  modified_base (11)..(11): base is a locked nucleic acid
  modified_base (17)..(17): base is a locked nucleic acid
  misc_feature (34)..(40): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 707 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (7)..(7): base is a locked nucleic acid
  misc_feature (15)..(21): Adaptor region of the pan degenerate sense primer that adapts the probe-binding site upstream of codon 115 to correspond to the nucleotides in an oligonucleotide probe upstream of the discriminating single nucleotide polymorphism.
trytrgatgtrggdgaygcat

SEQ ID NO: 708 - DNA, 21 bp, Artificial Sequence
  Pan degenerate oligonucleotide primer
  primer_bind (1)..(21)
  modified_base (1)..(1): base is a locked nucleic acid
  modified_base (6)..(6): base is a locked nucleic acid
  modified_base (7)..(7): base is a locked nucleic acid
  misc_feature (15)..(21): Adaptor region of the pan degenerate sense primer that adapts the probe-binding site upstream of codon 115 to correspond to the nucleotides in an oligonucleotide probe upstream of the discriminating single nucleotide polymorphism.
trytrgatgtrggdgaygcat

SEQ ID NO: 709 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (6)..(6): base is a locked nucleic acid
  misc_feature (15)..(21): Adaptor region of the pan degenerate sense primer that adapts the probe-binding site upstream of codon 115 to correspond to the nucleotides in an oligonucleotide probe upstream of the discriminating single nucleotide polymorphism.
trytrgatgtrggdgaygcat

SEQ ID NO: 710 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (9)..(9): base is a locked nucleic acid
  misc_feature (18)..(24): Adaptor region of the pan degenerate sense primer that adapts the probe-binding site upstream of codon 115 to correspond to the nucleotides in an oligonucleotide probe upstream of the discriminating single nucleotide polymorphism.
cagtrytrgatgtrggdgaygcat

SEQ ID NO: 711 - DNA, 24 bp, Artificial Sequence
  Pan degenerate oligonucleotide primer
  primer_bind (1)..(24)
  modified_base (1)..(1): base is a locked nucleic acid
  modified_base (7)..(7): base is a locked nucleic acid
  modified_base (9)..(9): base is a locked nucleic acid
  misc_feature (18)..(24): Adaptor region of the pan degenerate sense primer that adapts the probe-binding site upstream of codon 115 to correspond to the nucleotides in an oligonucleotide probe upstream of the discriminating single nucleotide polymorphism.
cagtrytrgatgtrggdgaygcat

SEQ ID NO: 712 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate sense primer that adapts the probe-binding site upstream of codon 115 to correspond to the nucleotides in an oligonucleotide probe upstream of the discriminating single nucleotide polymorphism.
cagtrytrgatgtrggdgaygcat

SEQ ID NO: 713 - DNA, 40 bp, Artificial Sequence; identical to SEQ ID NO: 689
  Pan degenerate oligonucleotide primer
  primer_bind (1)..(40)
  modified_base (4)..(4): base is a locked nucleic acid
  modified_base (7)..(7): base is a locked nucleic acid
  modified_base (11)..(11): base is a locked nucleic acid
  misc_feature (34)..(40): Adaptor region of the pan degenerate sense primer that adapts the probe-binding site upstream of codon 115 to correspond to the nucleotides in an oligonucleotide probe upstream of the discriminating single nucleotide polymorphism.

SEQ ID NO: 714 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 116 to correspond to the nucleotides in an oligonucleotide probe upstream of the discriminating single nucleotide polymorphism.
cagtracagtrytrgatgtrggdgaygcatayt

SEQ ID NO: 715 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 116 to correspond to the nucleotides in an oligonucleotide probe upstream of the discriminating single nucleotide polymorphism.
aaatcagtracagtrytrgatgtrggdgaygcatayt

SEQ ID NO: 716 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 116 to correspond to the nucleotides in an oligonucleotide probe upstream of the discriminating single nucleotide polymorphism.
aamaaatcagtracagtrytrgatgtrggdgaygcatayt

SEQ ID NO: 717 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 116 to correspond to the nucleotides in an oligonucleotide probe upstream of the discriminating single nucleotide polymorphism.
trgatgtrggdgaygcatayt

SEQ ID NO: 718 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 116 to correspond to the nucleotides in an oligonucleotide probe upstream of the discriminating single nucleotide polymorphism.
trytrgatgtrggdgaygcatayt

SEQ ID NO: 719 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 116 to correspond to the nucleotides in an oligonucleotide probe upstream of the discriminating single nucleotide polymorphism.
cagtrytrgatgtrggdgaygcatayt

SEQ ID NO: 720 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 116 to correspond to the nucleotides in an oligonucleotide probe upstream of the discriminating single nucleotide polymorphism.
aaraagaaraartcwgtracagtvytrgatgtrggdgatgcatat

SEQ ID NO: 721 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 116 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cagtracagtrytrgatgtrggdgaygcataytn

SEQ ID NO: 722 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 116 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
aaatcagtracagtrytrgatgtrggdgaygcataytn

SEQ ID NO: 723 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 116 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aamaaatcagtracagtrytrgatgtrggdgaygcataytn

SEQ ID NO: 724 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 116 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
trgatgtrggdgaygcataytn

SEQ ID NO: 725 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 116 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
trytrgatgtrggdgaygcataytn

SEQ ID NO: 726 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 116 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
cagtrytrgatgtrggdgaygcataytn

SEQ ID NO: 727 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 116 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aaraagaaraartcwgtracagtvytrgatgtrggdgatgcatatn

SEQ ID NO: 728 - DNA, 33 bp, Artificial Sequence; identical to SEQ ID NO: 714
  Pan degenerate oligonucleotide primer
  primer_bind (1)..(33)
  modified_base (1)..(1): base is a locked nucleic acid
  modified_base (7)..(7): base is a locked nucleic acid
  modified_base (13)..(13): base is a locked nucleic acid
  misc_feature (27)..(33): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 729 - DNA, 33 bp, Artificial Sequence; identical to SEQ ID NO: 714
  Pan degenerate oligonucleotide primer
  primer_bind (1)..(33)
  modified_base (1)..(1): base is a locked nucleic acid
  modified_base (10)..(10): base is a locked nucleic acid
  modified_base (13)..(13): base is a locked nucleic acid
  misc_feature (27)..(33): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 730 - DNA, 33 bp, Artificial Sequence; identical to SEQ ID NO: 714
  Pan degenerate oligonucleotide primer
  primer_bind (1)..(33)
  modified_base (1)..(1): base is a locked nucleic acid
  modified_base (7)..(7): base is a locked nucleic acid
  modified_base (10)..(10): base is a locked nucleic acid
  misc_feature (27)..(33): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 731 - DNA, 37 bp, Artificial Sequence; identical to SEQ ID NO: 715
  Pan degenerate oligonucleotide primer
  primer_bind (1)..(37)
  modified_base (1)..(1): base is a locked nucleic acid
  modified_base (5)..(5): base is a locked nucleic acid
  modified_base (14)..(14): base is a locked nucleic acid
  misc_feature (31)..(37): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 732 - DNA, 37 bp, Artificial Sequence; identical to SEQ ID NO: 715
  Pan degenerate oligonucleotide primer
  primer_bind (1)..(37)
  modified_base (1)..(1): base is a locked nucleic acid
  modified_base (11)..(11): base is a locked nucleic acid
  modified_base (14)..(14): base is a locked nucleic acid
  misc_feature (31)..(37): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 733 - DNA, 37 bp, Artificial Sequence; identical to SEQ ID NO: 715
  Pan degenerate oligonucleotide primer
  primer_bind (1)..(37)
  modified_base (1)..(1): base is a locked nucleic acid
  modified_base (5)..(5): base is a locked nucleic acid
  modified_base (11)..(11): base is a locked nucleic acid
  misc_feature (31)..(37): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 734 - DNA, 40 bp, Artificial Sequence; identical to SEQ ID NO: 716
  Pan degenerate oligonucleotide primer
  primer_bind (1)..(40)
  modified_base (1)..(1): base is a locked nucleic acid
  modified_base (4)..(4): base is a locked nucleic acid
  modified_base (14)..(14): base is a locked nucleic acid
  misc_feature (34)..(40): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 735 - DNA, 40 bp, Artificial Sequence; identical to SEQ ID NO: 716
  Pan degenerate oligonucleotide primer
  primer_bind (1)..(40)
  modified_base (1)..(1): base is a locked nucleic acid
  modified_base (8)..(8): base is a locked nucleic acid
  modified_base (14)..(14): base is a locked nucleic acid
  misc_feature (34)..(40): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 736 - DNA, 21 bp, Artificial Sequence
  Pan degenerate oligonucleotide primer
  primer_bind (1)..(21)
  modified_base (1)..(1): base is a locked nucleic acid
  modified_base (3)..(3): base is a locked nucleic acid
  modified_base (7)..(7): base is a locked nucleic acid
  misc_feature (15)..(21): Adaptor region of the pan degenerate sense primer that adapts the probe-binding site upstream of codon 116 to correspond to the nucleotides in an oligonucleotide probe upstream of the discriminating single nucleotide polymorphism.
trgatgtrggdgaygcatayt

SEQ ID NO: 737 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (7)..(7): base is a locked nucleic acid
  misc_feature (15)..(21): Adaptor region of the pan degenerate sense primer that adapts the probe-binding site upstream of codon 116 to correspond to the nucleotides in an oligonucleotide probe upstream of the discriminating single nucleotide polymorphism.
trgatgtrggdgaygcatayt

SEQ ID NO: 738 - DNA, 21 bp, Artificial Sequence
  Pan degenerate oligonucleotide primer
  primer_bind (1)..(21)
  modified_base (1)..(1): base is a locked nucleic acid
  modified_base (3)..(3): base is a locked nucleic acid
  modified_base (4)..(4): base is a locked nucleic acid
  misc_feature (15)..(21): Adaptor region of the pan degenerate sense primer that adapts the probe-binding site upstream of codon 116 to correspond to the nucleotides in an oligonucleotide probe upstream of the discriminating single nucleotide polymorphism.
trgatgtrggdgaygcatayt

SEQ ID NO: 739 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate sense primer that adapts the probe-binding site upstream of codon 116 to correspond to the nucleotides in an oligonucleotide probe upstream of the discriminating single nucleotide polymorphism.
trytrgatgtrggdgaygcatayt

SEQ ID NO: 740 - DNA, 24 bp, Artificial Sequence
  Pan degenerate oligonucleotide primer
  primer_bind (1)..(24)
  modified_base (1)..(1): base is a locked nucleic acid
  modified_base (6)..(6): base is a locked nucleic acid
  modified_base (7)..(7): base is a locked nucleic acid
  misc_feature (18)..(24): Adaptor region of the pan degenerate sense primer that adapts the probe-binding site upstream of codon 116 to correspond to the nucleotides in an oligonucleotide probe upstream of the discriminating single nucleotide polymorphism.
trytrgatgtrggdgaygcatayt

SEQ ID NO: 741 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (6)..(6): base is a locked nucleic acid
  misc_feature (18)..(24): Adaptor region of the pan degenerate sense primer that adapts the probe-binding site upstream of codon 116 to correspond to the nucleotides in an oligonucleotide probe upstream of the discriminating single nucleotide polymorphism.
trytrgatgtrggdgaygcatayt

SEQ ID NO: 742 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (9)..(9): base is a locked nucleic acid
  misc_feature (21)..(27): Adaptor region of the pan degenerate sense primer that adapts the probe-binding site upstream of codon 116 to correspond to the nucleotides in an oligonucleotide probe upstream of the discriminating single nucleotide polymorphism.
cagtrytrgatgtrggdgaygcatayt

SEQ ID NO: 743 - DNA, 27 bp, Artificial Sequence
  Pan degenerate oligonucleotide primer
  primer_bind (1)..(27)
  modified_base (1)..(1): base is a locked nucleic acid
  modified_base (7)..(7): base is a locked nucleic acid
  modified_base (9)..(9): base is a locked nucleic acid
  misc_feature (21)..(27): Adaptor region of the pan degenerate sense primer that adapts the probe-binding site upstream of codon 116 to correspond to the nucleotides in an oligonucleotide probe upstream of the discriminating single nucleotide polymorphism.
cagtrytrgatgtrggdgaygcatayt

SEQ ID NO: 744 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (7)..(7): base is a locked nucleic acid
  misc_feature (21)..(27): Adaptor region of the pan degenerate sense primer that adapts the probe-binding site upstream of codon 116 to correspond to the nucleotides in an oligonucleotide probe upstream of the discriminating single nucleotide polymorphism.
cagtrytrgatgtrggdgaygcatayt

SEQ ID NO: 745 - DNA, 40 bp, Artificial Sequence; identical to SEQ ID NO: 716
  Pan degenerate oligonucleotide primer
  primer_bind (1)..(40)
  modified_base (1)..(1): base is a locked nucleic acid
  modified_base (4)..(4): base is a locked nucleic acid
  modified_base (8)..(8): base is a locked nucleic acid
  misc_feature (34)..(40): Adaptor region of the pan degenerate sense primer that adapts the probe-binding site upstream of codon 116 to correspond to the nucleotides in an oligonucleotide probe upstream of the discriminating single nucleotide polymorphism.

SEQ ID NO: 746 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
trytrgatgtrggdgaygcatayttytca

SEQ ID NO: 747 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 118 to correspond to the nucleotides in an oligonucleotide probe upstream of the discriminating single nucleotide polymorphism.
cagtrytrgatgtrggdgaygcatayttytca

SEQ ID NO: 748 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.
atcagtracagtrytrgatgtrggdgaygcatayttytca

SEQ ID NO: 749 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 118 to correspond to the nucleotides in an oligonucleotide probe upstream of the discriminating single nucleotide polymorphism.
atgtrggdgaygcatayttytca

SEQ ID NO: 750 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 118 to correspond to the nucleotides in an oligonucleotide probe upstream of the discriminating single nucleotide polymorphism.
gatgtrggdgaygcatayttytca

SEQ ID NO: 751 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 118 to correspond to the nucleotides in an oligonucleotide probe upstream of the discriminating single nucleotide polymorphism.
trgatgtrggdgaygcatayttytca

SEQ ID NO: 752 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 118 to correspond to the nucleotides in an oligonucleotide probe upstream of the discriminating single nucleotide polymorphism.
aaraartcwgtracagtvytrgatgtrggdgatgcatatttttca

SEQ ID NO: 753 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
trytrgatgtrggdgaygcatayttytcan

SEQ ID NO: 754 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 118 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
cagtrytrgatgtrggdgaygcatayttytcan

SEQ ID NO: 755 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
atcagtracagtrytrgatgtrggdgaygcatayttytcan

SEQ ID NO: 756 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 118 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
atgtrggdgaygcatayttytcan

SEQ ID NO: 757 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 118 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
gatgtrggdgaygcatayttytcan

SEQ ID NO: 758 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 118 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
trgatgtrggdgaygcatayttytcan

SEQ ID NO: 759 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 118 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aaraartcwgtracagtvytrgatgtrggdgatgcatatttttcan

SEQ ID NO: 760 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
trytrgatgtrggdgaygcatayttytca

SEQ ID NO: 761 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
trytrgatgtrggdgaygcatayttytca

SEQ ID NO: 762 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate sense primer that adapts the probe-binding site upstream of codon 118 to correspond to the nucleotides in an oligonucleotide probe upstream of the discriminating single nucleotide polymorphism.
trytrgatgtrggdgaygcatayttytca

SEQ ID NO: 763 - DNA, 32 bp, Artificial Sequence; identical to SEQ ID NO: 747
  Pan degenerate oligonucleotide primer
  primer_bind (1)..(32)
  modified_base (1)..(1): base is a locked nucleic acid
  modified_base (4)..(4): base is a locked nucleic acid
  modified_base (9)..(9): base is a locked nucleic acid
  misc_feature (26)..(32): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 764 - DNA, 32 bp, Artificial Sequence; identical to SEQ ID NO: 747
  Pan degenerate oligonucleotide primer
  primer_bind (1)..(32)
  modified_base (1)..(1): base is a locked nucleic acid
  modified_base (7)..(7): base is a locked nucleic acid
  modified_base (9)..(9): base is a locked nucleic acid
  misc_feature (26)..(32): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 765 - DNA, 32 bp, Artificial Sequence; identical to SEQ ID NO: 747
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 766 - DNA, 40 bp, Artificial Sequence; identical to SEQ ID NO: 748
  Pan degenerate oligonucleotide primer
  primer_bind (1)..(40)
  modified_base (3)..(3): base is a locked nucleic acid
  modified_base (9)..(9): base is a locked nucleic acid
  modified_base (15)..(15): base is a locked nucleic acid
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 767 - DNA, 40 bp, Artificial Sequence; identical to SEQ ID NO: 748
  Pan degenerate oligonucleotide primer
  primer_bind (1)..(40)
  modified_base (3)..(3): base is a locked nucleic acid
  modified_base (12)..(12): base is a locked nucleic acid
  modified_base (15)..(15): base is a locked nucleic acid
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 768 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (7)..(7): base is a locked nucleic acid
  misc_feature (17)..(23): Adaptor region of the pan degenerate sense primer that adapts the probe-binding site upstream of codon 118 to correspond to the nucleotides in an oligonucleotide probe upstream of the discriminating single nucleotide polymorphism.
atgtrggdgaygcatayttytca

SEQ ID NO: 769 - DNA, 23 bp, Artificial Sequence
  Pan degenerate oligonucleotide primer
  primer_bind (1)..(23)
  modified_base (1)..(1): base is a locked nucleic acid
  modified_base (6)..(6): base is a locked nucleic acid
  modified_base (7)..(7): base is a locked nucleic acid
  misc_feature (17)..(23): Adaptor region of the pan degenerate sense primer that adapts the probe-binding site upstream of codon 118 to correspond to the nucleotides in an oligonucleotide probe upstream of the discriminating single nucleotide polymorphism.
atgtrggdgaygcatayttytca

SEQ ID NO: 770 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (6)..(6): base is a locked nucleic acid
  misc_feature (17)..(23): Adaptor region of the pan degenerate sense primer that adapts the probe-binding site upstream of codon 118 to correspond to the nucleotides in an oligonucleotide probe upstream of the discriminating single nucleotide polymorphism.
atgtrggdgaygcatayttytca

SEQ ID NO: 771 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (7)..(7): base is a locked nucleic acid
  misc_feature (18)..(24): Adaptor region of the pan degenerate sense primer that adapts the probe-binding site upstream of codon 118 to correspond to the nucleotides in an oligonucleotide probe upstream of the discriminating single nucleotide polymorphism.
gatgtrggdgaygcatayttytca

SEQ ID NO: 772 - DNA, 24 bp, Artificial Sequence
  Pan degenerate oligonucleotide primer
  primer_bind (1)..(24)
  modified_base (1)..(1): base is a locked nucleic acid
  modified_base (5)..(5): base is a locked nucleic acid
  modified_base (7)..(7): base is a locked nucleic acid
  misc_feature (18)..(24): Adaptor region of the pan degenerate sense primer that adapts the probe-binding site upstream of codon 118 to correspond to the nucleotides in an oligonucleotide probe upstream of the discriminating single nucleotide polymorphism.
gatgtrggdgaygcatayttytca

SEQ ID NO: 773 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (5)..(5): base is a locked nucleic acid
  misc_feature (18)..(24): Adaptor region of the pan degenerate sense primer that adapts the probe-binding site upstream of codon 118 to correspond to the nucleotides in an oligonucleotide probe upstream of the discriminating single nucleotide polymorphism.
gatgtrggdgaygcatayttytca

SEQ ID NO: 774 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (7)..(7): base is a locked nucleic acid
  misc_feature (20)..(26): Adaptor region of the pan degenerate sense primer that adapts the probe-binding site upstream of codon 118 to correspond to the nucleotides in an oligonucleotide probe upstream of the discriminating single nucleotide polymorphism.
trgatgtrggdgaygcatayttytca

SEQ ID NO: 775 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (7)..(7): base is a locked nucleic acid
  misc_feature (20)..(26): Adaptor region of the pan degenerate sense primer that adapts the probe-binding site upstream of codon 118 to correspond to the nucleotides in an oligonucleotide probe upstream of the discriminating single nucleotide polymorphism.
trgatgtrggdgaygcatayttytca

SEQ ID NO: 776 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate sense primer that adapts the probe-binding site upstream of codon 118 to correspond to the nucleotides in an oligonucleotide probe upstream of the discriminating single nucleotide polymorphism.
trgatgtrggdgaygcatayttytca

SEQ ID NO: 777 - DNA, 40 bp, Artificial Sequence; identical to SEQ ID NO: 748
  Pan degenerate oligonucleotide primer
  primer_bind (1)..(40)
  modified_base (3)..(3): base is a locked nucleic acid
  modified_base (9)..(9): base is a locked nucleic acid
  modified_base (12)..(12): base is a locked nucleic acid
  misc_feature (34)..(40): Adaptor region of the pan degenerate sense primer that adapts the probe-binding site upstream of codon 118 to correspond to the nucleotides in an oligonucleotide probe upstream of the discriminating single nucleotide polymorphism.

SEQ ID NO: 778 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.
aartayactgcattyacyatacctagtryaaayaat

SEQ ID NO: 779 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 138 to correspond to the nucleotides in an oligonucleotide probe upstream of the discriminating single nucleotide polymorphism.
aartayactgcattyacyatacctagtryaaayaatg

SEQ ID NO: 780 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 138 to correspond to the nucleotides in an oligonucleotide probe upstream of the discriminating single nucleotide polymorphism.
graartayactgcattyacyatacctagtryaaayaat

SEQ ID NO: 781 - DNA, 39 bp, Artificial Sequence
  Pan degenerate oligonucleotide primer
  primer_bind (1)..(39)
  misc_feature (33)..(39): Adaptor region of the pan degenerate sense primer that adapts the probe-binding site upstream of codon 138 to correspond to the nucleotides in an oligonucleotide probe upstream of the discriminating single nucleotide polymorphism.
graartayactgcattyacyatacctagtryaaayaatg

SEQ ID NO: 782 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
yagraartayactgcattyacyatacctagtryaaayaat

SEQ ID NO: 783 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
agraartayactgcattyacyatacctagtryaaayaatg

SEQ ID NO: 784 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 138 to correspond to the nucleotides in an oligonucleotide probe upstream of the discriminating single nucleotide polymorphism.
ayactgcattyacyatacctagtryaaayaat

SEQ ID NO: 785 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.
ayactgcattyacyatacctagtryaaayaatg

SEQ ID NO: 786 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.
tayactgcattyacyatacctagtryaaayaat

SEQ ID NO: 787 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 138 to correspond to the nucleotides in an oligonucleotide probe upstream of the discriminating single nucleotide polymorphism.
tayactgcattyacyatacctagtryaaayaatg

SEQ ID NO: 788 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 138 to correspond to the nucleotides in an oligonucleotide probe upstream of the discriminating single nucleotide polymorphism.
artayactgcattyacyatacctagtryaaayaat

SEQ ID NO: 789 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.
artayactgcattyacyatacctagtryaaayaatg

SEQ ID NO: 790 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 138 to correspond to the nucleotides in an oligonucleotide probe upstream of the discriminating single nucleotide polymorphism.
rrhttyagraartayactgcattyacyataccyagtrymaacaat

SEQ ID NO: 791 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
aartayactgcattyacyatacctagtryaaayaatn

SEQ ID NO: 792 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 138 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
aartayactgcattyacyatacctagtryaaayaatgn

SEQ ID NO: 793 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 138 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
graartayactgcattyacyatacctagtryaaayaatn

SEQ ID NO: 794 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 138 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
graartayactgcattyacyatacctagtryaaayaatgn

SEQ ID NO: 795 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
yagraartayactgcattyacyatacctagtryaaayaatn

SEQ ID NO: 796 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
agraartayactgcattyacyatacctagtryaaayaatgn

SEQ ID NO: 797 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 138 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
ayactgcattyacyatacctagtryaaayaatn

SEQ ID NO: 798 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ayactgcattyacyatacctagtryaaayaatgn

SEQ ID NO: 799 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tayactgcattyacyatacctagtryaaayaatn

SEQ ID NO: 800 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 138 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
tayactgcattyacyatacctagtryaaayaatgn

SEQ ID NO: 801 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 138 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
artayactgcattyacyatacctagtryaaayaatn

SEQ ID NO: 802 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
artayactgcattyacyatacctagtryaaayaatgn

SEQ ID NO: 803 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 138 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
rrhttyagraartayactgcattyacyataccyagtrymaacaatn

SEQ ID NO: 804 - DNA, 36 bp, Artificial Sequence; identical to SEQ ID NO: 778
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 805 - DNA, 37 bp, Artificial Sequence; identical to SEQ ID NO: 779
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 806 - DNA, 36 bp, Artificial Sequence; identical to SEQ ID NO: 778
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 807 - DNA, 37 bp, Artificial Sequence; identical to SEQ ID NO: 779
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 808 - DNA, 36 bp, Artificial Sequence; identical to SEQ ID NO: 778
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 809 - DNA, 37 bp, Artificial Sequence; identical to SEQ ID NO: 779
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 810 - DNA, 38 bp, Artificial Sequence; identical to SEQ ID NO: 780
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 811 - DNA, 39 bp, Artificial Sequence; identical to SEQ ID NO: 781
  Pan degenerate oligonucleotide primer
  primer_bind (1)..(39)
  modified_base (1)..(1): base is a locked nucleic acid
  modified_base (3)..(3): base is a locked nucleic acid
  modified_base (6)..(6): base is a locked nucleic acid
  misc_feature (33)..(39): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 812 - DNA, 38 bp, Artificial Sequence; identical to SEQ ID NO: 780
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 813 - DNA, 39 bp, Artificial Sequence; identical to SEQ ID NO: 781
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (33)..(39): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 814 - DNA, 38 bp, Artificial Sequence; identical to SEQ ID NO: 780
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 815 - DNA, 39 bp, Artificial Sequence; identical to SEQ ID NO: 781
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 816 - DNA, 40 bp, Artificial Sequence; identical to SEQ ID NO: 782
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 817 - DNA, 40 bp, Artificial Sequence; identical to SEQ ID NO: 783
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 818 - DNA, 40 bp, Artificial Sequence; identical to SEQ ID NO: 782
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 819 - DNA, 40 bp, Artificial Sequence; identical to SEQ ID NO: 783
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 820 - DNA, 32 bp, Artificial Sequence; identical to SEQ ID NO: 784
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 821 - DNA, 33 bp, Artificial Sequence; identical to SEQ ID NO: 785
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 822 - DNA, 32 bp, Artificial Sequence; identical to SEQ ID NO: 784
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 823 - DNA, 33 bp, Artificial Sequence; identical to SEQ ID NO: 785
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 824 - DNA, 32 bp, Artificial Sequence; identical to SEQ ID NO: 784
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 825 - DNA, 33 bp, Artificial Sequence; identical to SEQ ID NO: 785
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 826 - DNA, 33 bp, Artificial Sequence; identical to SEQ ID NO: 786
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 827 - DNA, 34 bp, Artificial Sequence; identical to SEQ ID NO: 787
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 828 - DNA, 33 bp, Artificial Sequence; identical to SEQ ID NO: 786
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 829 - DNA, 34 bp, Artificial Sequence; identical to SEQ ID NO: 787
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 830 - DNA, 33 bp, Artificial Sequence; identical to SEQ ID NO: 786
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 831 - DNA, 34 bp, Artificial Sequence; identical to SEQ ID NO: 787
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 832 - DNA, 35 bp, Artificial Sequence; identical to SEQ ID NO: 788
  Pan degenerate oligonucleotide primer
  primer_bind (1)..(35)
  modified_base (1)..(1): base is a locked nucleic acid
  modified_base (3)..(3): base is a locked nucleic acid
  modified_base (6)..(6): base is a locked nucleic acid
  misc_feature (29)..(35): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 833 - DNA, 36 bp, Artificial Sequence; identical to SEQ ID NO: 789
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 834 - DNA, 35 bp, Artificial Sequence; identical to SEQ ID NO: 788
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 835 - DNA, 36 bp, Artificial Sequence; identical to SEQ ID NO: 789
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 836 - DNA, 35 bp, Artificial Sequence; identical to SEQ ID NO: 788
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 837 - DNA, 36 bp, Artificial Sequence; identical to SEQ ID NO: 789
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 838 - DNA, 40 bp, Artificial Sequence; identical to SEQ ID NO: 782
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 839 - DNA, 40 bp, Artificial Sequence; identical to SEQ ID NO: 783
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 138 to correspond to the nucleotides in an oligonucleotide probe upstream of the discriminating single nucleotide polymorphism.

SEQ ID NO: 840 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 151 to correspond to the nucleotides in an oligonucleotide probe upstream of the discriminating single nucleotide polymorphism.
aayaatgaracaccaggrrtyagrtatcartayaatgtrcttcca

SEQ ID NO: 841 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 151 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aayaatgaracaccaggrrtyagrtatcartayaatgtrcttccan

SEQ ID NO: 842 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.
tyttagarccytttagrdhamaaaayccagavatrr

SEQ ID NO: 843 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 179 to correspond to the nucleotides in an oligonucleotide probe upstream of the discriminating single nucleotide polymorphism.
tyttagarccytttagrdhamaaaayccagavatr

SEQ ID NO: 844 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 179 to correspond to the nucleotides in an oligonucleotide probe upstream of the discriminating single nucleotide polymorphism.
atyttagarccytttagrdhamaaaayccagavatrr

SEQ ID NO: 845 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.
atyttagarccytttagrdhamaaaayccagavatr

SEQ ID NO: 846 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.
araatyttagarccytttagrdhamaaaayccagavatrr

SEQ ID NO: 847 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.
aaraatyttagarccytttagrdhamaaaayccagavatr

SEQ ID NO: 848 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatrr

SEQ ID NO: 849 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatr

SEQ ID NO: 850 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatrr

SEQ ID NO: 851 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatr

SEQ ID NO: 852 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 179 to correspond to the nucleotides in an oligonucleotide probe upstream of the discriminating single nucleotide polymorphism.
tagarccytttagrdhamaaaayccagavatrr

SEQ ID NO: 853 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 179 to correspond to the nucleotides in an oligonucleotide probe upstream of the discriminating single nucleotide polymorphism.
tagarccytttagrdhamaaaayccagavatr

SEQ ID NO: 854 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 179 to correspond to the nucleotides in an oligonucleotide probe upstream of the discriminating single nucleotide polymorphism.
atgacaaraatyttagarccytttagrrhrmaraayccagacata

SEQ ID NO: 855 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
tyttagarccytttagrdhamaaaayccagavatrrn

SEQ ID NO: 856 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 179 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
tyttagarccytttagrdhamaaaayccagavatrn

SEQ ID NO: 857 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 179 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
atyttagarccytttagrdhamaaaayccagavatrrn

SEQ ID NO: 858 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
atyttagarccytttagrdhamaaaayccagavatrn

SEQ ID NO: 859 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
araatyttagarccytttagrdhamaaaayccagavatrrn

SEQ ID NO: 860 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aaraatyttagarccytttagrdhamaaaayccagavatrn

SEQ ID NO: 861 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
cytttagrdhamaaaayccagavatrrn

SEQ ID NO: 862 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 179 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
cytttagrdhamaaaayccagavatrn

SEQ ID NO: 863 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 179 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
ccytttagrdhamaaaayccagavatrrn

SEQ ID NO: 864 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
ccytttagrdhamaaaayccagavatrn

SEQ ID NO: 865 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 179 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tagarccytttagrdhamaaaayccagavatrrn

SEQ ID NO: 866 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 179 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
tagarccytttagrdhamaaaayccagavatrn

SEQ ID NO: 867 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 179 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
atgacaaraatyttagarccytttagrrhrmaraayccagacatan

SEQ ID NO: 868 - DNA, 36 bp, Artificial Sequence; identical to SEQ ID NO: 842
  Pan degenerate oligonucleotide primer
  primer_bind (1)..(36)
  modified_base (1)..(1): base is a locked nucleic acid
  modified_base (4)..(4): base is a locked nucleic acid
  modified_base (10)..(10): base is a locked nucleic acid
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 869 - DNA, 35 bp, Artificial Sequence; identical to SEQ ID NO: 843
  Pan degenerate oligonucleotide primer
  primer_bind (1)..(35)
  modified_base (1)..(1): base is a locked nucleic acid
  modified_base (4)..(4): base is a locked nucleic acid
  modified_base (10)..(10): base is a locked nucleic acid
  misc_feature (29)..(35): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 870 - DNA, 36 bp, Artificial Sequence; identical to SEQ ID NO: 842
  Pan degenerate oligonucleotide primer
  primer_bind (1)..(36)
  modified_base (1)..(1): base is a locked nucleic acid
  modified_base (9)..(9): base is a locked nucleic acid
  modified_base (10)..(10): base is a locked nucleic acid
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 871 - DNA, 35 bp, Artificial Sequence; identical to SEQ ID NO: 843
  Pan degenerate oligonucleotide primer
  primer_bind (1)..(35)
  modified_base (1)..(1): base is a locked nucleic acid
  modified_base (9)..(9): base is a locked nucleic acid
  modified_base (10)..(10): base is a locked nucleic acid
  misc_feature (29)..(35): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 872 - DNA, 36 bp, Artificial Sequence; identical to SEQ ID NO: 842
  Pan degenerate oligonucleotide primer
  primer_bind (1)..(36)
  modified_base (1)..(1): base is a locked nucleic acid
  modified_base (4)..(4): base is a locked nucleic acid
  modified_base (9)..(9): base is a locked nucleic acid
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 873 - DNA, 35 bp, Artificial Sequence; identical to SEQ ID NO: 843
  Pan degenerate oligonucleotide primer
  primer_bind (1)..(35)
  modified_base (1)..(1): base is a locked nucleic acid
  modified_base (4)..(4): base is a locked nucleic acid
  modified_base (9)..(9): base is a locked nucleic acid
  misc_feature (29)..(35): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 874 - DNA, 37 bp, Artificial Sequence; identical to SEQ ID NO: 844
  Pan degenerate oligonucleotide primer
  primer_bind (1)..(37)
  modified_base (1)..(1): base is a locked nucleic acid
  modified_base (2)..(2): base is a locked nucleic acid
  modified_base (10)..(10): base is a locked nucleic acid
  misc_feature (31)..(37): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 875 - DNA, 36 bp, Artificial Sequence; identical to SEQ ID NO: 845
  Pan degenerate oligonucleotide primer
  primer_bind (1)..(36)
  modified_base (1)..(1): base is a locked nucleic acid
  modified_base (2)..(2): base is a locked nucleic acid
  modified_base (10)..(10): base is a locked nucleic acid
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 876 - DNA, 37 bp, Artificial Sequence; identical to SEQ ID NO: 844
  Pan degenerate oligonucleotide primer
  primer_bind (1)..(37)
  modified_base (1)..(1): base is a locked nucleic acid
  modified_base (5)..(5): base is a locked nucleic acid
  modified_base (10)..(10): base is a locked nucleic acid
  misc_feature (31)..(37): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 877 - DNA, 36 bp, Artificial Sequence; identical to SEQ ID NO: 845
  Pan degenerate oligonucleotide primer
  primer_bind (1)..(36)
  modified_base (1)..(1): base is a locked nucleic acid
  modified_base (5)..(5): base is a locked nucleic acid
  modified_base (10)..(10): base is a locked nucleic acid
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 878 - DNA, 37 bp, Artificial Sequence; identical to SEQ ID NO: 844
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 879 - DNA, 36 bp, Artificial Sequence; identical to SEQ ID NO: 845
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 880 - DNA, 40 bp, Artificial Sequence; identical to SEQ ID NO: 846
  Pan degenerate oligonucleotide primer
  primer_bind (1)..(40)
  modified_base (1)..(1): base is a locked nucleic acid
  modified_base (4)..(4): base is a locked nucleic acid
  modified_base (8)..(8): base is a locked nucleic acid
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 881 - DNA, 40 bp, Artificial Sequence; identical to SEQ ID NO: 847
  Pan degenerate oligonucleotide primer
  primer_bind (1)..(40)
  modified_base (2)..(2): base is a locked nucleic acid
  modified_base (5)..(5): base is a locked nucleic acid
  modified_base (9)..(9): base is a locked nucleic acid
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 882 - DNA, 40 bp, Artificial Sequence; identical to SEQ ID NO: 846
  Pan degenerate oligonucleotide primer
  primer_bind (1)..(40)
  modified_base (1)..(1): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 883 - DNA, 40 bp, Artificial Sequence; identical to SEQ ID NO: 847
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 884 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (16)..(16): base is a locked nucleic acid
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatrr

SEQ ID NO: 885 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (16)..(16): base is a locked nucleic acid
  misc_feature (20)..(26): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatr

SEQ ID NO: 886 - DNA, 27 bp, Artificial Sequence
  Pan degenerate oligonucleotide primer
  primer_bind (1)..(27)
  modified_base (1)..(1): base is a locked nucleic acid
  modified_base (6)..(6): base is a locked nucleic acid
  modified_base (16)..(16): base is a locked nucleic acid
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatrr

SEQ ID NO: 887 - DNA, 26 bp, Artificial Sequence
  Pan degenerate oligonucleotide primer
  primer_bind (1)..(26)
  modified_base (1)..(1): base is a locked nucleic acid
  modified_base (6)..(6): base is a locked nucleic acid
  modified_base (16)..(16): base is a locked nucleic acid
  misc_feature (20)..(26): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatr

SEQ ID NO: 888 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (6)..(6): base is a locked nucleic acid
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatrr

SEQ ID NO: 889 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (6)..(6): base is a locked nucleic acid
  misc_feature (20)..(26): Adaptor region of the pan degenerate sense primer that adapts the probe-binding site upstream of codon 179 to correspond to the nucleotides in an oligonucleotide probe upstream of the discriminating single nucleotide polymorphism.
cytttagrdhamaaaayccagavatr

SEQ ID NO: 890 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (7)..(7): base is a locked nucleic acid
  misc_feature (22)..(28): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatrr

SEQ ID NO: 891 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (7)..(7): base is a locked nucleic acid
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatr

SEQ ID NO: 892 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatrr

SEQ ID NO: 893 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (7)..(7): base is a locked nucleic acid
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatr

SEQ ID NO: 894 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (4)..(4): base is a locked nucleic acid
  misc_feature (22)..(28): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatrr

SEQ ID NO: 895 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (4)..(4): base is a locked nucleic acid
  misc_feature (21)..(27): Adaptor region of the pan degenerate sense primer that adapts the probe-binding site upstream of codon 179 to correspond to the nucleotides in an oligonucleotide probe upstream of the discriminating single nucleotide polymorphism.
ccytttagrdhamaaaayccagavatr

SEQ ID NO: 896 - DNA, 33 bp, Artificial Sequence; identical to SEQ ID NO: 852
  Pan degenerate oligonucleotide primer
  primer_bind (1)..(33)
  modified_base (1)..(1): base is a locked nucleic acid
  modified_base (6)..(6): base is a locked nucleic acid
  modified_base (9)..(9): base is a locked nucleic acid
  misc_feature (27)..(33): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 897 - DNA, 32 bp, Artificial Sequence; identical to SEQ ID NO: 853
  Pan degenerate oligonucleotide primer
  primer_bind (1)..(32)
  modified_base (1)..(1): base is a locked nucleic acid
  modified_base (6)..(6): base is a locked nucleic acid
  modified_base (9)..(9): base is a locked nucleic acid
  misc_feature (26)..(32): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 898 - DNA, 33 bp, Artificial Sequence; identical to SEQ ID NO: 852
  Pan degenerate oligonucleotide primer
  primer_bind (1)..(33)
  modified_base (1)..(1): base is a locked nucleic acid
  modified_base (7)..(7): base is a locked nucleic acid
  modified_base (9)..(9): base is a locked nucleic acid
  misc_feature (27)..(33): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 899 - DNA, 32 bp, Artificial Sequence; identical to SEQ ID NO: 853
  Pan degenerate oligonucleotide primer
  primer_bind (1)..(32)
  modified_base (1)..(1): base is a locked nucleic acid
  modified_base (7)..(7): base is a locked nucleic acid
  modified_base (9)..(9): base is a locked nucleic acid
  misc_feature (26)..(32): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 900 - DNA, 33 bp, Artificial Sequence; identical to SEQ ID NO: 852
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (27)..(33): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 901 - DNA, 32 bp, Artificial Sequence; identical to SEQ ID NO: 853
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 902 - DNA, 40 bp, Artificial Sequence; identical to SEQ ID NO: 846
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 903 - DNA, 40 bp, Artificial Sequence; identical to SEQ ID NO: 847
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 179 to correspond to the nucleotides in an oligonucleotide probe upstream of the discriminating single nucleotide polymorphism.

SEQ ID NO: 904 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 181 to correspond to the nucleotides in an oligonucleotide probe upstream of the discriminating single nucleotide polymorphism.
cytttagrdhamaaaayccagavatrrtbatyt

SEQ ID NO: 905 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 181 to correspond to the nucleotides in an oligonucleotide probe upstream of the discriminating single nucleotide polymorphism.
ccytttagrdhamaaaayccagavatrrtbatyt

SEQ ID NO: 906 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 181 to correspond to the nucleotides in an oligonucleotide probe upstream of the discriminating single nucleotide polymorphism.
ttagarccytttagrdhamaaaayccagavatrrtbatyt

SEQ ID NO: 907 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 181 to correspond to the nucleotides in an oligonucleotide probe upstream of the discriminating single nucleotide polymorphism.
agrdhamaaaayccagavatrrtbatyt

SEQ ID NO: 908 - DNA, 31 bp, Artificial Sequence
  Pan degenerate oligonucleotide primer
  primer_bind (1)..(31)
  misc_feature (25)..(31): Adaptor region of the pan degenerate sense primer that adapts the probe-binding site upstream of codon 181 to correspond to the nucleotides in an oligonucleotide probe upstream of the discriminating single nucleotide polymorphism.
tttagrdhamaaaayccagavatrrtbatyt

SEQ ID NO: 909 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 181 to correspond to the nucleotides in an oligonucleotide probe upstream of the discriminating single nucleotide polymorphism.
araatyttagarccytttagrrhrmaraayccagavmtrrttatc

SEQ ID NO: 910 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 181 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
cytttagrdhamaaaayccagavatrrtbatytn

SEQ ID NO: 911 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 181 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ccytttagrdhamaaaayccagavatrrtbatytn

SEQ ID NO: 912 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 181 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ttagarccytttagrdhamaaaayccagavatrrtbatytn

SEQ ID NO: 913 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 181 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
agrdhamaaaayccagavatrrtbatytn

SEQ ID NO: 914 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 181 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
tttagrdhamaaaayccagavatrrtbatytn

SEQ ID NO: 915 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 181 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
araatyttagarccytttagrrhrmaraayccagavmtrrttatcn

SEQ ID NO: 916 - DNA, 33 bp, Artificial Sequence; identical to SEQ ID NO: 904
  Pan degenerate oligonucleotide primer
  primer_bind (1)..(33)
  modified_base (1)..(1): base is a locked nucleic acid
  modified_base (3)..(3): base is a locked nucleic acid
  modified_base (16)..(16): base is a locked nucleic acid
  misc_feature (27)..(33): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 917 - DNA, 33 bp, Artificial Sequence; identical to SEQ ID NO: 904
  Pan degenerate oligonucleotide primer
  primer_bind (1)..(33)
  modified_base (1)..(1): base is a locked nucleic acid
  modified_base (6)..(6): base is a locked nucleic acid
  modified_base (16)..(16): base is a locked nucleic acid
  misc_feature (27)..(33): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 918 - DNA, 33 bp, Artificial Sequence; identical to SEQ ID NO: 904
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 919 - DNA, 34 bp, Artificial Sequence; identical to SEQ ID NO: 905
  Pan degenerate oligonucleotide primer
  primer_bind (1)..(34)
  modified_base (1)..(1): base is a locked nucleic acid
  modified_base (2)..(2): base is a locked nucleic acid
  modified_base (7)..(7): base is a locked nucleic acid
  misc_feature (28)..(34): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 920 - DNA, 34 bp, Artificial Sequence; identical to SEQ ID NO: 905
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 921 - DNA, 34 bp, Artificial Sequence; identical to SEQ ID NO: 905
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 922 - DNA, 40 bp, Artificial Sequence; identical to SEQ ID NO: 906
  Pan degenerate oligonucleotide primer
  primer_bind (1)..(40)
  modified_base (2)..(2): base is a locked nucleic acid
  modified_base (7)..(7): base is a locked nucleic acid
  modified_base (10)..(10): base is a locked nucleic acid
  misc_feature (34)..(40): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 923 - DNA, 40 bp, Artificial Sequence; identical to SEQ ID NO: 906
  Pan degenerate oligonucleotide primer
  primer_bind (1)..(40)
  modified_base (2)..(2): base is a locked nucleic acid
  modified_base (8)..(8): base is a locked nucleic acid
  modified_base (10)..(10): base is a locked nucleic acid
  misc_feature (34)..(40): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 924 - DNA, 28 bp, Artificial Sequence
  Pan degenerate oligonucleotide primer
  primer_bind (1)..(28)
  modified_base (1)..(1): base is a locked nucleic acid
  modified_base (11)..(11): base is a locked nucleic acid
  misc_feature (22)..(28): Adaptor region of the pan degenerate sense primer that adapts the probe-binding site upstream of codon 181 to correspond to the nucleotides in an oligonucleotide probe upstream of the discriminating single nucleotide polymorphism.
  modified_base (26)..(26): base is a locked nucleic acid
agrdhamaaaayccagavatrrtbatyt

SEQ ID NO: 925 - DNA, 28 bp, Artificial Sequence
  Pan degenerate oligonucleotide primer
  primer_bind (1)..(28)
  modified_base (1)..(1): base is a locked nucleic acid
  modified_base (20)..(20): base is a locked nucleic acid
  misc_feature (22)..(28): Adaptor region of the pan degenerate sense primer that adapts the probe-binding site upstream of codon 181 to correspond to the nucleotides in an oligonucleotide probe upstream of the discriminating single nucleotide polymorphism.
  modified_base (26)..(26): base is a locked nucleic acid
agrdhamaaaayccagavatrrtbatyt

SEQ ID NO: 926 - DNA, 28 bp, Artificial Sequence
  Pan degenerate oligonucleotide primer
  primer_bind (1)..(28)
  modified_base (1)..(1): base is a locked nucleic acid
  modified_base (11)..(11): base is a locked nucleic acid
  modified_base (20)..(20): base is a locked nucleic acid
  misc_feature (22)..(28): Adaptor region of the pan degenerate sense primer that adapts the probe-binding site upstream of codon 181 to correspond to the nucleotides in an oligonucleotide probe upstream of the discriminating single nucleotide polymorphism.
agrdhamaaaayccagavatrrtbatyt

SEQ ID NO: 927 - DNA, 31 bp, Artificial Sequence; identical to SEQ ID NO: 908
  Pan degenerate oligonucleotide primer
  primer_bind (1)..(31)
  modified_base (1)..(1): base is a locked nucleic acid
  modified_base (4)..(4): base is a locked nucleic acid
  modified_base (23)..(23): base is a locked nucleic acid
  misc_feature (25)..(31): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 928 - DNA, 31 bp, Artificial Sequence; identical to SEQ ID NO: 908
  Pan degenerate oligonucleotide primer
  primer_bind (1)..(31)
  modified_base (1)..(1): base is a locked nucleic acid
  modified_base (14)..(14): base is a locked nucleic acid
  modified_base (23)..(23): base is a locked nucleic acid
  misc_feature (25)..(31): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 929 - DNA, 31 bp, Artificial Sequence; identical to SEQ ID NO: 908
  Pan degenerate oligonucleotide primer
  primer_bind (1)..(31)
  modified_base (1)..(1): base is a locked nucleic acid
  modified_base (4)..(4): base is a locked nucleic acid
  modified_base (14)..(14): base is a locked nucleic acid
  misc_feature (25)..(31): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 930 - DNA, 40 bp, Artificial Sequence; identical to SEQ ID NO: 906
  Pan degenerate oligonucleotide primer
  primer_bind (1)..(40)
  modified_base (2)..(2): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 181 to correspond to the nucleotides in an oligonucleotide probe upstream of the discriminating single nucleotide polymorphism.

SEQ ID NO: 931 - DNA, 26 bp, Artificial Sequence
  Pan degenerate oligonucleotide primer
  primer_bind (1)..(26)
  misc_feature (20)..(26): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatay

SEQ ID NO: 932 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 184 to correspond to the nucleotides in an oligonucleotide probe upstream of the discriminating single nucleotide polymorphism.
agrdhamaaaayccagavatrrtbatytaycaatay

SEQ ID NO: 933 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatayrt

SEQ ID NO: 934 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.
ytttagrdhamaaaayccagavatrrtbatytaycaatay

SEQ ID NO: 935 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.
ttagrdhamaaaayccagavatrrtbatytaycaatayrt

SEQ ID NO: 936 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 184 to correspond to the nucleotides in an oligonucleotide probe upstream of the discriminating single nucleotide polymorphism.
garccytttagrrhrmaraayccagavmtrrtbatytatcaatac

SEQ ID NO: 937 - DNA, 27 bp, Artificial Sequence
  Pan degenerate oligonucleotide primer
  primer_bind (1)..(27)
  misc_feature (20)..(26): Adaptor region of the pan degenerate sense primer that adapts the probe-binding site upstream of codon 184 to correspond to the nucleotides in an oligonucleotide probe upstream of the discriminating single nucleotide polymorphism.
  modified_base (27)..(27): base is a locked nucleic acid
  misc_feature (27)..(27): n is a, c, g, or t
ayccagavatrrtbatytaycaatayn

SEQ ID NO: 938 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 184 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
agrdhamaaaayccagavatrrtbatytaycaatayn

SEQ ID NO: 939 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 184 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
ayccagavatrrtbatytaycaatayrtn

SEQ ID NO: 940 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ytttagrdhamaaaayccagavatrrtbatytaycaatayn

SEQ ID NO: 941 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ttagrdhamaaaayccagavatrrtbatytaycaatayrtn

SEQ ID NO: 942 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 184 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
garccytttagrrhrmaraayccagavmtrrtbatytatcaatacn

SEQ ID NO: 943 - DNA, 26 bp, Artificial Sequence
  Pan degenerate oligonucleotide primer
  primer_bind (1)..(26)
  modified_base (1)..(1): base is a locked nucleic acid
  modified_base (10)..(10): base is a locked nucleic acid
  modified_base (18)..(18): base is a locked nucleic acid
  misc_feature (20)..(26): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatay

SEQ ID NO: 944 - DNA, 26 bp, Artificial Sequence
  Pan degenerate oligonucleotide primer
  primer_bind (1)..(26)
  modified_base (1)..(1): base is a locked nucleic acid
  modified_base (16)..(16): base is a locked nucleic acid
  modified_base (18)..(18): base is a locked nucleic acid
  misc_feature (20)..(26): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatay

SEQ ID NO: 945 - DNA, 26 bp, Artificial Sequence
  Pan degenerate oligonucleotide primer
  primer_bind (1)..(26)
  modified_base (1)..(1): base is a locked nucleic acid
  modified_base (10)..(10): base is a locked nucleic acid
  modified_base (16)..(16): base is a locked nucleic acid
  misc_feature (20)..(26): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatay

SEQ ID NO: 946 - DNA, 36 bp, Artificial Sequence; identical to SEQ ID NO: 932
  Pan degenerate oligonucleotide primer
  primer_bind (1)..(36)
  modified_base (1)..(1): base is a locked nucleic acid
  modified_base (11)..(11): base is a locked nucleic acid
  modified_base (26)..(26): base is a locked nucleic acid
  misc_feature (30)..(36): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 947 - DNA, 28 bp, Artificial Sequence
  Pan degenerate oligonucleotide primer
  primer_bind (1)..(28)
  modified_base (1)..(1): base is a locked nucleic acid
  modified_base (10)..(10): base is a locked nucleic acid
  modified_base (18)..(18): base is a locked nucleic acid
  misc_feature (22)..(28): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatayrt

SEQ ID NO: 948 - DNA, 36 bp, Artificial Sequence; identical to SEQ ID NO: 932
  Pan degenerate oligonucleotide primer
  primer_bind (1)..(36)
  modified_base (1)..(1): base is a locked nucleic acid
  modified_base (20)..(20): base is a locked nucleic acid
  modified_base (26)..(26): base is a locked nucleic acid
  misc_feature (30)..(36): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 949 - DNA, 28 bp, Artificial Sequence
  Pan degenerate oligonucleotide primer
  primer_bind (1)..(28)
  modified_base (1)..(1): base is a locked nucleic acid
  modified_base (16)..(16): base is a locked nucleic acid
  modified_base (18)..(18): base is a locked nucleic acid
  misc_feature (22)..(28): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatayrt

SEQ ID NO: 950 - DNA, 36 bp, Artificial Sequence; identical to SEQ ID NO: 932
  Pan degenerate oligonucleotide primer
  primer_bind (1)..(36)
  modified_base (1)..(1): base is a locked nucleic acid
  modified_base (11)..(11): base is a locked nucleic acid
  modified_base (20)..(20): base is a locked nucleic acid
  misc_feature (30)..(36): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 951 - DNA, 28 bp, Artificial Sequence
  Pan degenerate oligonucleotide primer
  primer_bind (1)..(28)
  modified_base (1)..(1): base is a locked nucleic acid
  modified_base (10)..(10): base is a locked nucleic acid
  modified_base (16)..(16): base is a locked nucleic acid
  misc_feature (22)..(28): Adaptor region of the pan degenerate sense primer that adapts the probe-binding site upstream of codon 184 to correspond to the nucleotides in an oligonucleotide probe upstream of the discriminating single nucleotide polymorphism.
ayccagavatrrtbatytaycaatayrt

SEQ ID NO: 952 - DNA, 40 bp, Artificial Sequence; identical to SEQ ID NO: 934
  Pan degenerate oligonucleotide primer
  primer_bind (1)..(40)
  modified_base (2)..(2): base is a locked nucleic acid
  modified_base (5)..(5): base is a locked nucleic acid
  modified_base (24)..(24): base is a locked nucleic acid
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 953 - DNA, 40 bp, Artificial Sequence; identical to SEQ ID NO: 935
  Pan degenerate oligonucleotide primer
  primer_bind (1)..(40)
  modified_base (3)..(3): base is a locked nucleic acid
  modified_base (13)..(13): base is a locked nucleic acid
  modified_base (28)..(28): base is a locked nucleic acid
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 954 - DNA, 40 bp, Artificial Sequence; identical to SEQ ID NO: 934
  Pan degenerate oligonucleotide primer
  primer_bind (1)..(40)
  modified_base (2)..(2): base is a locked nucleic acid
  modified_base (15)..(15): base is a locked nucleic acid
  modified_base (24)..(24): base is a locked nucleic acid
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 955 - DNA, 40 bp, Artificial Sequence; identical to SEQ ID NO: 935
  Pan degenerate oligonucleotide primer
  primer_bind (1)..(40)
  modified_base (3)..(3): base is a locked nucleic acid
  modified_base (22)..(22): base is a locked nucleic acid
  modified_base (28)..(28): base is a locked nucleic acid
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 956 - DNA, 40 bp, Artificial Sequence; identical to SEQ ID NO: 934
  Pan degenerate oligonucleotide primer
  primer_bind (1)..(40)
  modified_base (2)..(2): base is a locked nucleic acid
  modified_base (5)..(5): base is a locked nucleic acid
  modified_base (15)..(15): base is a locked nucleic acid
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 957 - DNA, 40 bp, Artificial Sequence; identical to SEQ ID NO: 935
  Pan degenerate oligonucleotide primer
  primer_bind (1)..(40)
  modified_base (3)..(3): base is a locked nucleic acid
  modified_base (13)..(13): base is a locked nucleic acid
  modified_base (22)..(22): base is a locked nucleic acid
  misc_feature (34)..(40): Adaptor region of the pan degenerate sense primer that adapts the probe-binding site upstream of codon 184 to correspond to the nucleotides in an oligonucleotide probe upstream of the discriminating single nucleotide polymorphism.

SEQ ID NO: 958 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttrt

SEQ ID NO: 959 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttr

SEQ ID NO: 960 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 188 to correspond to the nucleotides in an oligonucleotide probe upstream of the discriminating single nucleotide polymorphism.
trrtbatytaycaatayrtggatgayttrt

SEQ ID NO: 961 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 188 to correspond to the nucleotides in an oligonucleotide probe upstream of the discriminating single nucleotide polymorphism.
trrtbatytaycaatayrtggatgayttr

SEQ ID NO: 962 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.
aayccagavatrrtbatytaycaatayrtggatgayttrt

SEQ ID NO: 963 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.
aaayccagavatrrtbatytaycaatayrtggatgayttr

SEQ ID NO: 964 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttrt

SEQ ID NO: 965 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttr

SEQ ID NO: 966 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 188 to correspond to the nucleotides in an oligonucleotide probe upstream of the discriminating single nucleotide polymorphism.
rhrmaraayccagavmtrrtbatytaycartayatggatgatttg

SEQ ID NO: 967 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 188 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
tytaycaatayrtggatgayttrtn

SEQ ID NO: 968 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 188 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
tytaycaatayrtggatgayttrn

SEQ ID NO: 969 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 188 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
trrtbatytaycaatayrtggatgayttrtn

SEQ ID NO: 970 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 188 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
trrtbatytaycaatayrtggatgayttrn

SEQ ID NO: 971 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aayccagavatrrtbatytaycaatayrtggatgayttrtn

SEQ ID NO: 972 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
aaayccagavatrrtbatytaycaatayrtggatgayttrn

SEQ ID NO: 973 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 188 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
taycaatayrtggatgayttrtn

SEQ ID NO: 974 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 188 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
taycaatayrtggatgayttrn

SEQ ID NO: 975 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 188 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
rhrmaraayccagavmtrrtbatytaycartayatggatgatttgn

SEQ ID NO: 976 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (7)..(7): base is a locked nucleic acid
  misc_feature (18)..(24): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttrt

SEQ ID NO: 977 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (7)..(7): base is a locked nucleic acid
  misc_feature (17)..(23): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttr

SEQ ID NO: 978 - DNA, 24 bp, Artificial Sequence
  Pan degenerate oligonucleotide primer
  primer_bind (1)..(24)
  modified_base (1)..(1): base is a locked nucleic acid
  modified_base (6)..(6): base is a locked nucleic acid
  modified_base (7)..(7): base is a locked nucleic acid
  misc_feature (18)..(24): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttrt

SEQ ID NO: 979 - DNA, 23 bp, Artificial Sequence
  Pan degenerate oligonucleotide primer
  primer_bind (1)..(23)
  modified_base (1)..(1): base is a locked nucleic acid
  modified_base (6)..(6): base is a locked nucleic acid
  modified_base (7)..(7): base is a locked nucleic acid
  misc_feature (17)..(23): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttr

SEQ ID NO: 980 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (6)..(6): base is a locked nucleic acid
  misc_feature (18)..(24): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttrt

SEQ ID NO: 981 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (6)..(6): base is a locked nucleic acid
  misc_feature (17)..(23): Adaptor region of the pan degenerate sense primer that adapts the probe-binding site upstream of codon 188 to correspond to the nucleotides in an oligonucleotide probe upstream of the discriminating single nucleotide polymorphism.
tytaycaatayrtggatgayttr

SEQ ID NO: 982 - DNA, 30 bp, Artificial Sequence; identical to SEQ ID NO: 960
  Pan degenerate oligonucleotide primer
  primer_bind (1)..(30)
  modified_base (1)..(1): base is a locked nucleic acid
  modified_base (7)..(7): base is a locked nucleic acid
  modified_base (12)..(12): base is a locked nucleic acid
  misc_feature (24)..(30): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 983 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (12)..(12): base is a locked nucleic acid
  misc_feature (23)..(29): Adaptor region of the pan degenerate sense primer that adapts the probe-binding site upstream of codon 188 to correspond to the nucleotides in an oligonucleotide probe upstream of the discriminating single nucleotide polymorphism.
trrtbatytaycaatayrtggatgayttr

SEQ ID NO: 984 - DNA, 30 bp, Artificial Sequence; identical to SEQ ID NO: 960
  Pan degenerate oligonucleotide primer
  primer_bind (1)..(30)
  modified_base (1)..(1): base is a locked nucleic acid
  modified_base (9)..(9): base is a locked nucleic acid
  modified_base (12)..(12): base is a locked nucleic acid
  misc_feature (24)..(30): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 985 - DNA, 29 bp, Artificial Sequence
  Pan degenerate oligonucleotide primer
  primer_bind (1)..(29)
  modified_base (1)..(1): base is a locked nucleic acid
  modified_base (9)..(9): base is a locked nucleic acid
  modified_base (12)..(12): base is a locked nucleic acid
  misc_feature (23)..(29): Adaptor region of the pan degenerate sense primer that adapts the probe-binding site upstream of codon 188 to correspond to the nucleotides in an oligonucleotide probe upstream of the discriminating single nucleotide polymorphism.
trrtbatytaycaatayrtggatgayttr

SEQ ID NO: 986 - DNA, 30 bp, Artificial Sequence; identical to SEQ ID NO: 960
  Pan degenerate oligonucleotide primer
  primer_bind (1)..(30)
  modified_base (1)..(1): base is a locked nucleic acid
  modified_base (7)..(7): base is a locked nucleic acid
  modified_base (9)..(9): base is a locked nucleic acid
  misc_feature (24)..(30): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 987 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (9)..(9): base is a locked nucleic acid
  misc_feature (23)..(29): Adaptor region of the pan degenerate sense primer that adapts the probe-binding site upstream of codon 188 to correspond to the nucleotides in an oligonucleotide probe upstream of the discriminating single nucleotide polymorphism.
trrtbatytaycaatayrtggatgayttr

SEQ ID NO: 988 - DNA, 40 bp, Artificial Sequence; identical to SEQ ID NO: 962
  Pan degenerate oligonucleotide primer
  primer_bind (1)..(40)
  modified_base (2)..(2): base is a locked nucleic acid
  modified_base (11)..(11): base is a locked nucleic acid
  modified_base (19)..(19): base is a locked nucleic acid
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 989 - DNA, 40 bp, Artificial Sequence; identical to SEQ ID NO: 963
  Pan degenerate oligonucleotide primer
  primer_bind (1)..(40)
  modified_base (3)..(3): base is a locked nucleic acid
  modified_base (12)..(12): base is a locked nucleic acid
  modified_base (20)..(20): base is a locked nucleic acid
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 990 - DNA, 40 bp, Artificial Sequence; identical to SEQ ID NO: 962
  Pan degenerate oligonucleotide primer
  primer_bind (1)..(40)
  modified_base (2)..(2): base is a locked nucleic acid
  modified_base (17)..(17): base is a locked nucleic acid
  modified_base (19)..(19): base is a locked nucleic acid
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 991 - DNA, 40 bp, Artificial Sequence; identical to SEQ ID NO: 963
  Pan degenerate oligonucleotide primer
  primer_bind (1)..(40)
  modified_base (3)..(3): base is a locked nucleic acid
  modified_base (18)..(18): base is a locked nucleic acid
  modified_base (20)..(20): base is a locked nucleic acid
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 992 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (7)..(7): base is a locked nucleic acid
  misc_feature (16)..(22): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttrt

SEQ ID NO: 993 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (7)..(7): base is a locked nucleic acid
  misc_feature (15)..(21): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttr

SEQ ID NO: 994 - DNA, 22 bp, Artificial Sequence
  Pan degenerate oligonucleotide primer
  primer_bind (1)..(22)
  modified_base (1)..(1): base is a locked nucleic acid
  modified_base (5)..(5): base is a locked nucleic acid
  modified_base (7)..(7): base is a locked nucleic acid
  misc_feature (16)..(22): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttrt

SEQ ID NO: 995 - DNA, 21 bp, Artificial Sequence
  Pan degenerate oligonucleotide primer
  primer_bind (1)..(21)
  modified_base (1)..(1): base is a locked nucleic acid
  modified_base (5)..(5): base is a locked nucleic acid
  modified_base (7)..(7): base is a locked nucleic acid
  misc_feature (15)..(21): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttr

SEQ ID NO: 996 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (5)..(5): base is a locked nucleic acid
  misc_feature (16)..(22): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttrt

SEQ ID NO: 997 - DNA, 21 bp, Artificial Sequence
  Pan degenerate oligonucleotide primer
  primer_bind (1)..(21)
  modified_base (1)..(1): base is a locked nucleic acid
  modified_base (4)..(4): base is a locked nucleic acid
  modified_base (5)..(5): base is a locked nucleic acid
  misc_feature (15)..(21): Adaptor region of the pan degenerate sense primer that adapts the probe-binding site upstream of codon 188 to correspond to the nucleotides in an oligonucleotide probe upstream of the discriminating single nucleotide polymorphism.
taycaatayrtggatgayttr

SEQ ID NO: 998 - DNA, 40 bp, Artificial Sequence; identical to SEQ ID NO: 962
  Pan degenerate oligonucleotide primer
  primer_bind (1)..(40)
  modified_base (2)..(2): base is a locked nucleic acid
  modified_base (11)..(11): base is a locked nucleic acid
  modified_base (17)..(17): base is a locked nucleic acid
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 999 - DNA, 40 bp, Artificial Sequence; identical to SEQ ID NO: 963
  Pan degenerate oligonucleotide primer
  primer_bind (1)..(40)
  modified_base (3)..(3): base is a locked nucleic acid
  modified_base (12)..(12): base is a locked nucleic acid
  modified_base (18)..(18): base is a locked nucleic acid
  misc_feature (34)..(40): Adaptor region of the pan degenerate sense primer that adapts the probe-binding site upstream of codon 188 to correspond to the nucleotides in an oligonucleotide probe upstream of the discriminating single nucleotide polymorphism.

SEQ ID NO: 1000 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgtag

SEQ ID NO: 1001 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgta

SEQ ID NO: 1002 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 190 to correspond to the nucleotides in an oligonucleotide probe upstream of the discriminating single nucleotide polymorphism.
tytaycaatayrtggatgayttrtatgtag

SEQ ID NO: 1003 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 190 to correspond to the nucleotides in an oligonucleotide probe upstream of the discriminating single nucleotide polymorphism.
tytaycaatayrtggatgayttrtatgta

SEQ ID NO: 1004 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.
gavatrrtbatytaycaatayrtggatgayttrtatgtag

SEQ ID NO: 1005 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.
agavatrrtbatytaycaatayrtggatgayttrtatgta

SEQ ID NO: 1006 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgtag

SEQ ID NO: 1007 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgta

SEQ ID NO: 1008 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgtag

SEQ ID NO: 1009 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgta

SEQ ID NO: 1010 - DNA, 25 bp, Artificial Sequence
  Pan degenerate oligonucleotide primer
  primer_bind (1)..(25)
  misc_feature (19)..(25): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgtag

SEQ ID NO: 1011 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgta

SEQ ID NO: 1012 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 190 to correspond to the nucleotides in an oligonucleotide probe upstream of the discriminating single nucleotide polymorphism.
aayccagavmtrrtbatytaycartayatggatgayttrtatgta

SEQ ID NO: 1013 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 190 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
taycaatayrtggatgayttrtatgtagn

SEQ ID NO: 1014 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 190 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
taycaatayrtggatgayttrtatgtan

SEQ ID NO: 1015 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 190 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
tytaycaatayrtggatgayttrtatgtagn

SEQ ID NO: 1016 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 190 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
tytaycaatayrtggatgayttrtatgtan

SEQ ID NO: 1017 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
gavatrrtbatytaycaatayrtggatgayttrtatgtagn

SEQ ID NO: 1018 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
agavatrrtbatytaycaatayrtggatgayttrtatgtan

SEQ ID NO: 1019 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 190 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
tayrtggatgayttrtatgtagn

SEQ ID NO: 1020 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 190 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
tayrtggatgayttrtatgtan

SEQ ID NO: 1021 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
aatayrtggatgayttrtatgtagn

SEQ ID NO: 1022 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 190 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
aatayrtggatgayttrtatgtan

SEQ ID NO: 1023 - DNA, 26 bp, Artificial Sequence
  Pan degenerate oligonucleotide primer
  primer_bind (1)..(26)
  misc_feature (19)..(25): Adaptor region of the pan degenerate sense primer that adapts the probe-binding site upstream of codon 190 to correspond to the nucleotides in an oligonucleotide probe upstream of the discriminating single nucleotide polymorphism.
  modified_base (26)..(26): base is a locked nucleic acid
  misc_feature (26)..(26): n is a, c, g, or t
caatayrtggatgayttrtatgtagn

SEQ ID NO: 1024 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
caatayrtggatgayttrtatgtan

SEQ ID NO: 1025 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 190 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aayccagavmtrrtbatytaycartayatggatgayttrtatgtan

SEQ ID NO: 1026 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgtag

SEQ ID NO: 1027 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (7)..(7): base is a locked nucleic acid
  misc_feature (21)..(27): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgta

SEQ ID NO: 1028 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (7)..(7): base is a locked nucleic acid
  misc_feature (22)..(28): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgtag

SEQ ID NO: 1029 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (7)..(7): base is a locked nucleic acid
  misc_feature (21)..(27): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgta

SEQ ID NO: 1030 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (5)..(5): base is a locked nucleic acid
  misc_feature (22)..(28): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgtag

SEQ ID NO: 1031 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate sense primer that adapts the probe-binding site upstream of codon 190 to correspond to the nucleotides in an oligonucleotide probe upstream of the discriminating single nucleotide polymorphism.
taycaatayrtggatgayttrtatgta

SEQ ID NO: 1032 - DNA, 30 bp, Artificial Sequence; identical to SEQ ID NO: 1002
  Pan degenerate oligonucleotide primer
  primer_bind (1)..(30)
  modified_base (1)..(1): base is a locked nucleic acid
  modified_base (3)..(3): base is a locked nucleic acid
  modified_base (7)..(7): base is a locked nucleic acid
  misc_feature (24)..(30): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1033 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (7)..(7): base is a locked nucleic acid
  misc_feature (23)..(29): Adaptor region of the pan degenerate sense primer that adapts the probe-binding site upstream of codon 190 to correspond to the nucleotides in an oligonucleotide probe upstream of the discriminating single nucleotide polymorphism.
tytaycaatayrtggatgayttrtatgta

SEQ ID NO: 1034 - DNA, 30 bp, Artificial Sequence; identical to SEQ ID NO: 1002
  Pan degenerate oligonucleotide primer
  primer_bind (1)..(30)
  modified_base (1)..(1): base is a locked nucleic acid
  modified_base (6)..(6): base is a locked nucleic acid
  modified_base (7)..(7): base is a locked nucleic acid
  misc_feature (24)..(30): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1035 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate sense primer that adapts the probe-binding site upstream of codon 190 to correspond to the nucleotides in an oligonucleotide probe upstream of the discriminating single nucleotide polymorphism.
tytaycaatayrtggatgayttrtatgta

SEQ ID NO: 1036 - DNA, 30 bp, Artificial Sequence; identical to SEQ ID NO: 1002
  Pan degenerate oligonucleotide primer
  primer_bind (1)..(30)
  modified_base (1)..(1): base is a locked nucleic acid
  modified_base (3)..(3): base is a locked nucleic acid
  modified_base (6)..(6): base is a locked nucleic acid
  misc_feature (24)..(30): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1037 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate sense primer that adapts the probe-binding site upstream of codon 190 to correspond to the nucleotides in an oligonucleotide probe upstream of the discriminating single nucleotide polymorphism.
tytaycaatayrtggatgayttrtatgta

SEQ ID NO: 1038 - DNA, 40 bp, Artificial Sequence; identical to SEQ ID NO: 1004
  Pan degenerate oligonucleotide primer
  primer_bind (1)..(40)
  modified_base (5)..(5): base is a locked nucleic acid
  modified_base (11)..(11): base is a locked nucleic acid
  modified_base (16)..(16): base is a locked nucleic acid
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1039 - DNA, 40 bp, Artificial Sequence; identical to SEQ ID NO: 1005
  Pan degenerate oligonucleotide primer
  primer_bind (1)..(40)
  modified_base (6)..(6): base is a locked nucleic acid
  modified_base (12)..(12): base is a locked nucleic acid
  modified_base (17)..(17): base is a locked nucleic acid
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1040 - DNA, 40 bp, Artificial Sequence; identical to SEQ ID NO: 1004
  Pan degenerate oligonucleotide primer
  primer_bind (1)..(40)
  modified_base (5)..(5): base is a locked nucleic acid
  modified_base (13)..(13): base is a locked nucleic acid
  modified_base (16)..(16): base is a locked nucleic acid
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1041 - DNA, 40 bp, Artificial Sequence; identical to SEQ ID NO: 1005
  Pan degenerate oligonucleotide primer
  primer_bind (1)..(40)
  modified_base (6)..(6): base is a locked nucleic acid
  modified_base (14)..(14): base is a locked nucleic acid
  modified_base (17)..(17): base is a locked nucleic acid
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1042 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (7)..(7): base is a locked nucleic acid
  misc_feature (16)..(22): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgtag

SEQ ID NO: 1043 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (7)..(7): base is a locked nucleic acid
  misc_feature (15)..(21): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgta

SEQ ID NO: 1044 - DNA, 22 bp, Artificial Sequence
  Pan degenerate oligonucleotide primer
  primer_bind (1)..(22)
  modified_base (1)..(1): base is a locked nucleic acid
  modified_base (5)..(5): base is a locked nucleic acid
  modified_base (7)..(7): base is a locked nucleic acid
  misc_feature (16)..(22): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgtag

SEQ ID NO: 1045 - DNA, 21 bp, Artificial Sequence
  Pan degenerate oligonucleotide primer
  primer_bind (1)..(21)
  modified_base (1)..(1): base is a locked nucleic acid
  modified_base (5)..(5): base is a locked nucleic acid
  modified_base (7)..(7): base is a locked nucleic acid
  misc_feature (15)..(21): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgta

SEQ ID NO: 1046 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (5)..(5): base is a locked nucleic acid
  misc_feature (16)..(22): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgtag

SEQ ID NO: 1047 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (5)..(5): base is a locked nucleic acid
  misc_feature (15)..(21): Adaptor region of the pan degenerate sense primer that adapts the probe-binding site upstream of codon 190 to correspond to the nucleotides in an oligonucleotide probe upstream of the discriminating single nucleotide polymorphism.
tayrtggatgayttrtatgta

SEQ ID NO: 1048 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (7)..(7): base is a locked nucleic acid
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgtag

SEQ ID NO: 1049 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (7)..(7): base is a locked nucleic acid
  misc_feature (17)..(23): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgta

SEQ ID NO: 1050 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgtag

SEQ ID NO: 1051 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (7)..(7): base is a locked nucleic acid
  misc_feature (17)..(23): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgta

SEQ ID NO: 1052 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (4)..(4): base is a locked nucleic acid
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgtag

SEQ ID NO: 1053 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (4)..(4): base is a locked nucleic acid
  misc_feature (17)..(23): Adaptor region of the pan degenerate sense primer that adapts the probe-binding site upstream of codon 190 to correspond to the nucleotides in an oligonucleotide probe upstream of the discriminating single nucleotide polymorphism.
aatayrtggatgayttrtatgta

SEQ ID NO: 1054 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (5)..(5): base is a locked nucleic acid
  misc_feature (19)..(25): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgtag

SEQ ID NO: 1055 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (5)..(5): base is a locked nucleic acid
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgta

SEQ ID NO: 1056 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (5)..(5): base is a locked nucleic acid
  misc_feature (19)..(25): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgtag

SEQ ID NO: 1057 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (5)..(5): base is a locked nucleic acid
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgta

SEQ ID NO: 1058 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (4)..(4): base is a locked nucleic acid
  misc_feature (19)..(25): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgtag

SEQ ID NO: 1059 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate sense primer that adapts the probe-binding site upstream of codon 190 to correspond to the nucleotides in an oligonucleotide probe upstream of the discriminating single nucleotide polymorphism.
caatayrtggatgayttrtatgta

SEQ ID NO: 1060 - DNA, 40 bp, Artificial Sequence; identical to SEQ ID NO: 1004
  Pan degenerate oligonucleotide primer
  primer_bind (1)..(40)
  modified_base (5)..(5): base is a locked nucleic acid
  modified_base (11)..(11): base is a locked nucleic acid
  modified_base (13)..(13): base is a locked nucleic acid
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1061 - DNA, 40 bp, Artificial Sequence; identical to SEQ ID NO: 1005
  Pan degenerate oligonucleotide primer
  primer_bind (1)..(40)
  modified_base (6)..(6): base is a locked nucleic acid
  modified_base (12)..(12): base is a locked nucleic acid
  modified_base (14)..(14): base is a locked nucleic acid
  misc_feature (34)..(40): Adaptor region of the pan degenerate sense primer that adapts the probe-binding site upstream of codon 190 to correspond to the nucleotides in an oligonucleotide probe upstream of the discriminating single nucleotide polymorphism.

SEQ ID NO: 1062 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 210 to correspond to the nucleotides in an oligonucleotide probe upstream of the discriminating single nucleotide polymorphism.
agaryaaaartagargarytragrvmdcayytry

SEQ ID NO: 1063 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 210 to correspond to the nucleotides in an oligonucleotide probe upstream of the discriminating single nucleotide polymorphism.
ayagaryaaaartagargarytragrvmdcayytry

SEQ ID NO: 1064 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 210 to correspond to the nucleotides in an oligonucleotide probe upstream of the discriminating single nucleotide polymorphism.
carcayagaryaaaartagargarytragrvmdcayytry

SEQ ID NO: 1065 - DNA, 24 bp, Artificial Sequence
  Pan degenerate oligonucleotide primer
  primer_bind (1)..(24)
  misc_feature (18)..(24): Adaptor region of the pan degenerate sense primer that adapts the probe-binding site upstream of codon 210 to correspond to the nucleotides in an oligonucleotide probe upstream of the discriminating single nucleotide polymorphism.
tagargarytragrvmdcayytry

SEQ ID NO: 1066 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 210 to correspond to the nucleotides in an oligonucleotide probe upstream of the discriminating single nucleotide polymorphism.
aaartagargarytragrvmdcayytry

SEQ ID NO: 1067 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 210 to correspond to the nucleotides in an oligonucleotide probe upstream of the discriminating single nucleotide polymorphism.
garyaaaartagargarytragrvmdcayytry

SEQ ID NO: 1068 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 210 to correspond to the nucleotides in an oligonucleotide probe upstream of the discriminating single nucleotide polymorphism.
atagrrcarcayagaryaaaartagargarytragrvmdcatctg

SEQ ID NO: 1069 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 210 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
agaryaaaartagargarytragrvmdcayytryn

SEQ ID NO: 1070 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 210 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
ayagaryaaaartagargarytragrvmdcayytryn

SEQ ID NO: 1071 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 210 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
carcayagaryaaaartagargarytragrvmdcayytryn

SEQ ID NO: 1072 - DNA, 25 bp, Artificial Sequence
  Pan degenerate oligonucleotide primer
  primer_bind (1)..(25)
  misc_feature (18)..(24): Adaptor region of the pan degenerate sense primer that adapts the probe-binding site upstream of codon 210 to correspond to the nucleotides in an oligonucleotide probe upstream of the discriminating single nucleotide polymorphism.
  modified_base (25)..(25): base is a locked nucleic acid
  misc_feature (25)..(25): n is a, c, g, or t
tagargarytragrvmdcayytryn

SEQ ID NO: 1073 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 210 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
aaartagargarytragrvmdcayytryn

SEQ ID NO: 1074 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 210 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
garyaaaartagargarytragrvmdcayytryn

SEQ ID NO: 1075 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 210 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
atagrrcarcayagaryaaaartagargarytragrvmdcatctgn

SEQ ID NO: 1076 - DNA, 34 bp, Artificial Sequence; identical to SEQ ID NO: 1062
  Pan degenerate oligonucleotide primer
  primer_bind (1)..(34)
  modified_base (1)..(1): base is a locked nucleic acid
  modified_base (2)..(2): base is a locked nucleic acid
  modified_base (11)..(11): base is a locked nucleic acid
  misc_feature (28)..(34): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1077 - DNA, 34 bp, Artificial Sequence; identical to SEQ ID NO: 1062
  Pan degenerate oligonucleotide primer
  primer_bind (1)..(34)
  modified_base (1)..(1): base is a locked nucleic acid
  modified_base (7)..(7): base is a locked nucleic acid
  modified_base (11)..(11): base is a locked nucleic acid
  misc_feature (28)..(34): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1078 - DNA, 34 bp, Artificial Sequence; identical to SEQ ID NO: 1062
  Pan degenerate oligonucleotide primer
  primer_bind (1)..(34)
  modified_base (1)..(1): base is a locked nucleic acid
  modified_base (2)..(2): base is a locked nucleic acid
  modified_base (7)..(7): base is a locked nucleic acid
  misc_feature (28)..(34): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1079 - DNA, 36 bp, Artificial Sequence; identical to SEQ ID NO: 1063
  Pan degenerate oligonucleotide primer
  primer_bind (1)..(36)
  modified_base (1)..(1): base is a locked nucleic acid
  modified_base (3)..(3): base is a locked nucleic acid
  modified_base (9)..(9): base is a locked nucleic acid
  misc_feature (30)..(36): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1080 - DNA, 36 bp, Artificial Sequence; identical to SEQ ID NO: 1063
  Pan degenerate oligonucleotide primer
  primer_bind (1)..(36)
  modified_base (1)..(1): base is a locked nucleic acid
  modified_base (4)..(4): base is a locked nucleic acid
  modified_base (9)..(9): base is a locked nucleic acid
  misc_feature (30)..(36): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1081 - DNA, 36 bp, Artificial Sequence; identical to SEQ ID NO: 1063
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1082 - DNA, 40 bp, Artificial Sequence; identical to SEQ ID NO: 1064
  Pan degenerate oligonucleotide primer
  primer_bind (1)..(40)
  modified_base (4)..(4): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1083 - DNA, 40 bp, Artificial Sequence; identical to SEQ ID NO: 1064
  Pan degenerate oligonucleotide primer
  primer_bind (1)..(40)
  modified_base (4)..(4): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1084 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (10)..(10): base is a locked nucleic acid
  misc_feature (18)..(24): Adaptor region of the pan degenerate sense primer that adapts the probe-binding site upstream of codon 210 to correspond to the nucleotides in an oligonucleotide probe upstream of the discriminating single nucleotide polymorphism.
tagargarytragrvmdcayytry

SEQ ID NO: 1085 - DNA, 24 bp, Artificial Sequence
  Pan degenerate oligonucleotide primer
  primer_bind (1)..(24)
  modified_base (1)..(1): base is a locked nucleic acid
  modified_base (7)..(7): base is a locked nucleic acid
  modified_base (10)..(10): base is a locked nucleic acid
  misc_feature (18)..(24): Adaptor region of the pan degenerate sense primer that adapts the probe-binding site upstream of codon 210 to correspond to the nucleotides in an oligonucleotide probe upstream of the discriminating single nucleotide polymorphism.
tagargarytragrvmdcayytry

SEQ ID NO: 1086 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate sense primer that adapts the probe-binding site upstream of codon 210 to correspond to the nucleotides in an oligonucleotide probe upstream of the discriminating single nucleotide polymorphism.
tagargarytragrvmdcayytry

SEQ ID NO: 1087 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (11)..(11): base is a locked nucleic acid
  misc_feature (22)..(28): Adaptor region of the pan degenerate sense primer that adapts the probe-binding site upstream of codon 210 to correspond to the nucleotides in an oligonucleotide probe upstream of the discriminating single nucleotide polymorphism.
aaartagargarytragrvmdcayytry

SEQ ID NO: 1088 - DNA, 28 bp, Artificial Sequence
  Pan degenerate oligonucleotide primer
  primer_bind (1)..(28)
  modified_base (1)..(1): base is a locked nucleic acid
  modified_base (8)..(8): base is a locked nucleic acid
  modified_base (11)..(11): base is a locked nucleic acid
  misc_feature (22)..(28): Adaptor region of the pan degenerate sense primer that adapts the probe-binding site upstream of codon 210 to correspond to the nucleotides in an oligonucleotide probe upstream of the discriminating single nucleotide polymorphism.
aaartagargarytragrvmdcayytry

SEQ ID NO: 1089 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (8)..(8): base is a locked nucleic acid
  misc_feature (22)..(28): Adaptor region of the pan degenerate sense primer that adapts the probe-binding site upstream of codon 210 to correspond to the nucleotides in an oligonucleotide probe upstream of the discriminating single nucleotide polymorphism.
aaartagargarytragrvmdcayytry

SEQ ID NO: 1090 - DNA, 33 bp, Artificial Sequence; identical to SEQ ID NO: 1067
  Pan degenerate oligonucleotide primer
  primer_bind (1)..(33)
  modified_base (1)..(1): base is a locked nucleic acid
  modified_base (6)..(6): base is a locked nucleic acid
  modified_base (13)..(13): base is a locked nucleic acid
  misc_feature (27)..(33): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1091 - DNA, 33 bp, Artificial Sequence; identical to SEQ ID NO: 1067
  Pan degenerate oligonucleotide primer
  primer_bind (1)..(33)
  modified_base (1)..(1): base is a locked nucleic acid
  modified_base (10)..(10): base is a locked nucleic acid
  modified_base (13)..(13): base is a locked nucleic acid
  misc_feature (27)..(33): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1092 - DNA, 33 bp, Artificial Sequence; identical to SEQ ID NO: 1067
  Pan degenerate oligonucleotide primer
  primer_bind (1)..(33)
  modified_base (1)..(1): base is a locked nucleic acid
  modified_base (6)..(6): base is a locked nucleic acid
  modified_base (10)..(10): base is a locked nucleic acid
  misc_feature (27)..(33): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1093 - DNA, 40 bp, Artificial Sequence; identical to SEQ ID NO: 1064
  Pan degenerate oligonucleotide primer
  primer_bind (1)..(40)
  modified_base (4)..(4): base is a locked nucleic acid
  modified_base (5)..(5): base is a locked nucleic acid
  modified_base (7)..(7): base is a locked nucleic acid
  misc_feature (34)..(40): Adaptor region of the pan degenerate sense primer that adapts the probe-binding site upstream of codon 210 to correspond to the nucleotides in an oligonucleotide probe upstream of the discriminating single nucleotide polymorphism.

SEQ ID NO: 1094 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 215 to correspond to the nucleotides in an oligonucleotide probe upstream of the discriminating single nucleotide polymorphism.
arytragrvmdcayytrytrarvtggggrytyw

SEQ ID NO: 1095 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 215 to correspond to the nucleotides in an oligonucleotide probe upstream of the discriminating single nucleotide polymorphism.
argarytragrvmdcayytrytrarvtggggrytyw

SEQ ID NO: 1096 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 215 to correspond to the nucleotides in an oligonucleotide probe upstream of the discriminating single nucleotide polymorphism.
rtagargarytragrvmdcayytrytrarvtggggrytyw

SEQ ID NO: 1097 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 215 to correspond to the nucleotides in an oligonucleotide probe upstream of the discriminating single nucleotide polymorphism.
grvmdcayytrytrarvtggggrytyw

SEQ ID NO: 1098 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 215 to correspond to the nucleotides in an oligonucleotide probe upstream of the discriminating single nucleotide polymorphism.
agrvmdcayytrytrarvtggggrytyw

SEQ ID NO: 1099 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 215 to correspond to the nucleotides in an oligonucleotide probe upstream of the discriminating single nucleotide polymorphism.
tragrvmdcayytrytrarvtggggrytyw

SEQ ID NO: 1100 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 215 to correspond to the nucleotides in an oligonucleotide probe upstream of the discriminating single nucleotide polymorphism.
ryaaaartagargarytragrvmdcayytrytrarvtggggattt

SEQ ID NO: 1101 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 215 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
arytragrvmdcayytrytrarvtggggrytywn

SEQ ID NO: 1102 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 215 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
argarytragrvmdcayytrytrarvtggggrytywn

SEQ ID NO: 1103 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 215 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rtagargarytragrvmdcayytrytrarvtggggrytywn

SEQ ID NO: 1104 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 215 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
grvmdcayytrytrarvtggggrytywn

SEQ ID NO: 1105 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 215 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
agrvmdcayytrytrarvtggggrytywn

SEQ ID NO: 1106 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 215 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
tragrvmdcayytrytrarvtggggrytywn

SEQ ID NO: 1107 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 215 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ryaaaartagargarytragrvmdcayytrytrarvtggggatttn

SEQ ID NO: 1108 - DNA, 33 bp, Artificial Sequence; identical to SEQ ID NO: 1094
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1109 - DNA, 33 bp, Artificial Sequence; identical to SEQ ID NO: 1094
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (27)..(33): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1110 - DNA, 33 bp, Artificial Sequence; identical to SEQ ID NO: 1094
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1111 - DNA, 36 bp, Artificial Sequence; identical to SEQ ID NO: 1095
  Pan degenerate oligonucleotide primer
  primer_bind (1)..(36)
  modified_base (1)..(1): base is a locked nucleic acid
  modified_base (4)..(4): base is a locked nucleic acid
  modified_base (9)..(9): base is a locked nucleic acid
  misc_feature (30)..(36): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1112 - DNA, 36 bp, Artificial Sequence; identical to SEQ ID NO: 1095
  Pan degenerate oligonucleotide primer
  primer_bind (1)..(36)
  modified_base (1)..(1): base is a locked nucleic acid
  modified_base (7)..(7): base is a locked nucleic acid
  modified_base (9)..(9): base is a locked nucleic acid
  misc_feature (30)..(36): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1113 - DNA, 36 bp, Artificial Sequence; identical to SEQ ID NO: 1095
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1114 - DNA, 40 bp, Artificial Sequence; identical to SEQ ID NO: 1096
  Pan degenerate oligonucleotide primer
  primer_bind (1)..(40)
  modified_base (2)..(2): base is a locked nucleic acid
  modified_base (5)..(5): base is a locked nucleic acid
  modified_base (11)..(11): base is a locked nucleic acid
  misc_feature (34)..(40): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1115 - DNA, 40 bp, Artificial Sequence; identical to SEQ ID NO: 1096
  Pan degenerate oligonucleotide primer
  primer_bind (1)..(40)
  modified_base (2)..(2): base is a locked nucleic acid
  modified_base (8)..(8): base is a locked nucleic acid
  modified_base (11)..(11): base is a locked nucleic acid
  misc_feature (34)..(40): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1116 - DNA, 27 bp, Artificial Sequence
  Pan degenerate oligonucleotide primer
  primer_bind (1)..(27)
  modified_base (1)..(1): base is a locked nucleic acid
  modified_base (7)..(7): base is a locked nucleic acid
  modified_base (18)..(18): base is a locked nucleic acid
  misc_feature (21)..(27): Adaptor region of the pan degenerate sense primer that adapts the probe-binding site upstream of codon 215 to correspond to the nucleotides in an oligonucleotide probe upstream of the discriminating single nucleotide polymorphism.
grvmdcayytrytrarvtggggrytyw

SEQ ID NO: 1117 - DNA, 27 bp, Artificial Sequence
  Pan degenerate oligonucleotide primer
  primer_bind (1)..(27)
  modified_base (1)..(1): base is a locked nucleic acid
  modified_base (10)..(10): base is a locked nucleic acid
  modified_base (18)..(18): base is a locked nucleic acid
  misc_feature (21)..(27): Adaptor region of the pan degenerate sense primer that adapts the probe-binding site upstream of codon 215 to correspond to the nucleotides in an oligonucleotide probe upstream of the discriminating single nucleotide polymorphism.
grvmdcayytrytrarvtggggrytyw

SEQ ID NO: 1118 - DNA, 27 bp, Artificial Sequence
  Pan degenerate oligonucleotide primer
  primer_bind (1)..(27)
  modified_base (1)..(1): base is a locked nucleic acid
  modified_base (7)..(7): base is a locked nucleic acid
  modified_base (10)..(10): base is a locked nucleic acid
  misc_feature (21)..(27): Adaptor region of the pan degenerate sense primer that adapts the probe-binding site upstream of codon 215 to correspond to the nucleotides in an oligonucleotide probe upstream of the discriminating single nucleotide polymorphism.
grvmdcayytrytrarvtggggrytyw

SEQ ID NO: 1119 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (11)..(11): base is a locked nucleic acid
  misc_feature (22)..(28): Adaptor region of the pan degenerate sense primer that adapts the probe-binding site upstream of codon 215 to correspond to the nucleotides in an oligonucleotide probe upstream of the discriminating single nucleotide polymorphism.
agrvmdcayytrytrarvtggggrytyw

SEQ ID NO: 1120 - DNA, 28 bp, Artificial Sequence
  Pan degenerate oligonucleotide primer
  primer_bind (1)..(28)
  modified_base (1)..(1): base is a locked nucleic acid
  modified_base (8)..(8): base is a locked nucleic acid
  modified_base (11)..(11): base is a locked nucleic acid
  misc_feature (22)..(28): Adaptor region of the pan degenerate sense primer that adapts the probe-binding site upstream of codon 215 to correspond to the nucleotides in an oligonucleotide probe upstream of the discriminating single nucleotide polymorphism.
agrvmdcayytrytrarvtggggrytyw

SEQ ID NO: 1121 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (8)..(8): base is a locked nucleic acid
  misc_feature (22)..(28): Adaptor region of the pan degenerate sense primer that adapts the probe-binding site upstream of codon 215 to correspond to the nucleotides in an oligonucleotide probe upstream of the discriminating single nucleotide polymorphism.
agrvmdcayytrytrarvtggggrytyw

SEQ ID NO: 1122 - DNA, 30 bp, Artificial Sequence; identical to SEQ ID NO: 1099
  Pan degenerate oligonucleotide primer
  primer_bind (1)..(30)
  modified_base (1)..(1): base is a locked nucleic acid
  modified_base (3)..(3): base is a locked nucleic acid
  modified_base (10)..(10): base is a locked nucleic acid
  misc_feature (24)..(30): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1123 - DNA, 30 bp, Artificial Sequence; identical to SEQ ID NO: 1099
  Pan degenerate oligonucleotide primer
  primer_bind (1)..(30)
  modified_base (1)..(1): base is a locked nucleic acid
  modified_base (4)..(4): base is a locked nucleic acid
  modified_base (10)..(10): base is a locked nucleic acid
  misc_feature (24)..(30): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1124 - DNA, 30 bp, Artificial Sequence; identical to SEQ ID NO: 1099
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1125 - DNA, 40 bp, Artificial Sequence; identical to SEQ ID NO: 1096
  Pan degenerate oligonucleotide primer
  primer_bind (1)..(40)
  modified_base (2)..(2): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 215 to correspond to the nucleotides in an oligonucleotide probe upstream of the discriminating single nucleotide polymorphism.

SEQ ID NO: 1126 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 219 to correspond to the nucleotides in an oligonucleotide probe upstream of the discriminating single nucleotide polymorphism.
ayytrytrarvtggggrytywcyacaccagay

SEQ ID NO: 1127 - DNA, 31 bp, Artificial Sequence
  Pan degenerate oligonucleotide primer
  primer_bind (1)..(31)
  misc_feature (25)..(31): Adaptor region of the pan degenerate sense primer that adapts the probe-binding site upstream of codon 219 to correspond to the nucleotides in an oligonucleotide probe upstream of the discriminating single nucleotide polymorphism.
trytrarvtggggrytywcyacaccagayaa

SEQ ID NO: 1128 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 219 to correspond to the nucleotides in an oligonucleotide probe upstream of the discriminating single nucleotide polymorphism.
ayytrytrarvtggggrytywcyacaccagaya

SEQ ID NO: 1129 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 219 to correspond to the nucleotides in an oligonucleotide probe upstream of the discriminating single nucleotide polymorphism.
grvmdcayytrytrarvtggggrytywcyacaccagay

SEQ ID NO: 1130 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 219 to correspond to the nucleotides in an oligonucleotide probe upstream of the discriminating single nucleotide polymorphism.
ayytrytrarvtggggrytywcyacaccagayaa

SEQ ID NO: 1131 - DNA, 39 bp, Artificial Sequence
  Pan degenerate oligonucleotide primer
  primer_bind (1)..(39)
  misc_feature (33)..(39): Adaptor region of the pan degenerate sense primer that adapts the probe-binding site upstream of codon 219 to correspond to the nucleotides in an oligonucleotide probe upstream of the discriminating single nucleotide polymorphism.
grvmdcayytrytrarvtggggrytywcyacaccagaya

SEQ ID NO: 1132 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.
ragrvmdcayytrytrarvtggggrytywcyacaccagay

SEQ ID NO: 1133 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.
grvmdcayytrytrarvtggggrytywcyacaccagayaa

SEQ ID NO: 1134 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.
agrvmdcayytrytrarvtggggrytywcyacaccagaya

SEQ ID NO: 1135 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
gggrytywcyacaccagayaa

SEQ ID NO: 1136 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagaya

SEQ ID NO: 1137 - DNA, 21 bp, Artificial Sequence
  Pan degenerate oligonucleotide primer
  primer_bind (1)..(21)
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagay

SEQ ID NO: 1138 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagayaa

SEQ ID NO: 1139 - DNA, 22 bp, Artificial Sequence
  Pan degenerate oligonucleotide primer
  primer_bind (1)..(22)
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagaya

SEQ ID NO: 1140 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 219 to correspond to the nucleotides in an oligonucleotide probe upstream of the discriminating single nucleotide polymorphism.
trytrarvtggggrytywcyacaccagay

SEQ ID NO: 1141 - DNA, 23 bp, Artificial Sequence
  Pan degenerate oligonucleotide primer
  primer_bind (1)..(23)
  misc_feature (17)..(23): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagayaa

SEQ ID NO: 1142 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 219 to correspond to the nucleotides in an oligonucleotide probe upstream of the discriminating single nucleotide polymorphism.
trytrarvtggggrytywcyacaccagaya

SEQ ID NO: 1143 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 219 to correspond to the nucleotides in an oligonucleotide probe upstream of the discriminating single nucleotide polymorphism.
garytragrvmdcayytrytrarvtggggrytywmyacmccagac

SEQ ID NO: 1144 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 219 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
ayytrytrarvtggggrytywcyacaccagayn

SEQ ID NO: 1145 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 219 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
trytrarvtggggrytywcyacaccagayaan

SEQ ID NO: 1146 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 219 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
ayytrytrarvtggggrytywcyacaccagayan

SEQ ID NO: 1147 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 219 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
grvmdcayytrytrarvtggggrytywcyacaccagayn

SEQ ID NO: 1148 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 219 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
ayytrytrarvtggggrytywcyacaccagayaan

SEQ ID NO: 1149 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 219 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
grvmdcayytrytrarvtggggrytywcyacaccagayan

SEQ ID NO: 1150 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ragrvmdcayytrytrarvtggggrytywcyacaccagayn

SEQ ID NO: 1151 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
grvmdcayytrytrarvtggggrytywcyacaccagayaan

SEQ ID NO: 1152 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
agrvmdcayytrytrarvtggggrytywcyacaccagayan

SEQ ID NO: 1153 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
gggrytywcyacaccagayaan

SEQ ID NO: 1154 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
ggggrytywcyacaccagayan

SEQ ID NO: 1155 - DNA, 22 bp, Artificial Sequence
  Pan degenerate oligonucleotide primer
  primer_bind (1)..(22)
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
  modified_base (22)..(22): base is a locked nucleic acid
  misc_feature (22)..(22): n is a, c, g, or t
tggggrytywcyacaccagayn

SEQ ID NO: 1156 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
ggggrytywcyacaccagayaan

SEQ ID NO: 1157 - DNA, 23 bp, Artificial Sequence
  Pan degenerate oligonucleotide primer
  primer_bind (1)..(23)
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
  modified_base (23)..(23): base is a locked nucleic acid
  misc_feature (23)..(23): n is a, c, g, or t
tggggrytywcyacaccagayan

SEQ ID NO: 1158 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 219 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
trytrarvtggggrytywcyacaccagayn

SEQ ID NO: 1159 - DNA, 24 bp, Artificial Sequence
  Pan degenerate oligonucleotide primer
  primer_bind (1)..(24)
  misc_feature (17)..(23): Adaptor region of the pan degenerate sense primer that adapts the probe-binding site upstream of codon 219 to correspond to the nucleotides in an oligonucleotide probe upstream of the discriminating single nucleotide polymorphism.
  modified_base (24)..(24): base is a locked nucleic acid
  misc_feature (24)..(24): n is a, c, g, or t
tggggrytywcyacaccagayaan

SEQ ID NO: 1160 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 219 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
trytrarvtggggrytywcyacaccagayan

SEQ ID NO: 1161 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 219 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
garytragrvmdcayytrytrarvtggggrytywmyacmccagacn

SEQ ID NO: 1162 - DNA, 32 bp, Artificial Sequence; identical to SEQ ID NO: 1126
  Pan degenerate oligonucleotide primer
  primer_bind (1)..(32)
  modified_base (1)..(1): base is a locked nucleic acid
  modified_base (4)..(4): base is a locked nucleic acid
  modified_base (13)..(13): base is a locked nucleic acid
  misc_feature (26)..(32): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1163 - DNA, 31 bp, Artificial Sequence; identical to SEQ ID NO: 1127
  Pan degenerate oligonucleotide primer
  primer_bind (1)..(31)
  modified_base (1)..(1): base is a locked nucleic acid
  modified_base (9)..(9): base is a locked nucleic acid
  modified_base (11)..(11): base is a locked nucleic acid
  misc_feature (25)..(31): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1164 - DNA, 33 bp, Artificial Sequence; identical to SEQ ID NO: 1128
  Pan degenerate oligonucleotide primer
  primer_bind (1)..(33)
  modified_base (1)..(1): base is a locked nucleic acid
  modified_base (4)..(4): base is a locked nucleic acid
  modified_base (13)..(13): base is a locked nucleic acid
  misc_feature (27)..(33): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1165 - DNA, 32 bp, Artificial Sequence; identical to SEQ ID NO: 1126
  Pan degenerate oligonucleotide primer
  primer_bind (1)..(32)
  modified_base (1)..(1): base is a locked nucleic acid
  modified_base (12)..(12): base is a locked nucleic acid
  modified_base (13)..(13): base is a locked nucleic acid
  misc_feature (26)..(32): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1166 - DNA, 31 bp, Artificial Sequence; identical to SEQ ID NO: 1127
  Pan degenerate oligonucleotide primer
  primer_bind (1)..(31)
  modified_base (1)..(1): base is a locked nucleic acid
  modified_base (10)..(10): base is a locked nucleic acid
  modified_base (11)..(11): base is a locked nucleic acid
  misc_feature (25)..(31): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1167 - DNA, 33 bp, Artificial Sequence; identical to SEQ ID NO: 1128
  Pan degenerate oligonucleotide primer
  primer_bind (1)..(33)
  modified_base (1)..(1): base is a locked nucleic acid
  modified_base (12)..(12): base is a locked nucleic acid
  modified_base (13)..(13): base is a locked nucleic acid
  misc_feature (27)..(33): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1168 - DNA, 32 bp, Artificial Sequence; identical to SEQ ID NO: 1126
  Pan degenerate oligonucleotide primer
  primer_bind (1)..(32)
  modified_base (1)..(1): base is a locked nucleic acid
  modified_base (4)..(4): base is a locked nucleic acid
  modified_base (12)..(12): base is a locked nucleic acid
  misc_feature (26)..(32): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1169 - DNA, 31 bp, Artificial Sequence; identical to SEQ ID NO: 1127
  Pan degenerate oligonucleotide primer
  primer_bind (1)..(31)
  modified_base (1)..(1): base is a locked nucleic acid
  modified_base (9)..(9): base is a locked nucleic acid
  modified_base (10)..(10): base is a locked nucleic acid
  misc_feature (25)..(31): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1170 - DNA, 33 bp, Artificial Sequence; identical to SEQ ID NO: 1128
  Pan degenerate oligonucleotide primer
  primer_bind (1)..(33)
  modified_base (1)..(1): base is a locked nucleic acid
  modified_base (4)..(4): base is a locked nucleic acid
  modified_base (12)..(12): base is a locked nucleic acid
  misc_feature (27)..(33): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1171 - DNA, 38 bp, Artificial Sequence; identical to SEQ ID NO: 1129
  Pan degenerate oligonucleotide primer
  primer_bind (1)..(38)
  modified_base (1)..(1): base is a locked nucleic acid
  modified_base (7)..(7): base is a locked nucleic acid
  modified_base (18)..(18): base is a locked nucleic acid
  misc_feature (32)..(38): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1172 - DNA, 34 bp, Artificial Sequence; identical to SEQ ID NO: 1130
  Pan degenerate oligonucleotide primer
  primer_bind (1)..(34)
  modified_base (1)..(1): base is a locked nucleic acid
  modified_base (4)..(4): base is a locked nucleic acid
  modified_base (13)..(13): base is a locked nucleic acid
  misc_feature (28)..(34): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1173 - DNA, 39 bp, Artificial Sequence; identical to SEQ ID NO: 1131
  Pan degenerate oligonucleotide primer
  primer_bind (1)..(39)
  modified_base (1)..(1): base is a locked nucleic acid
  modified_base (7)..(7): base is a locked nucleic acid
  modified_base (18)..(18): base is a locked nucleic acid
  misc_feature (33)..(39): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1174 - DNA, 38 bp, Artificial Sequence; identical to SEQ ID NO: 1129
  Pan degenerate oligonucleotide primer
  primer_bind (1)..(38)
  modified_base (1)..(1): base is a locked nucleic acid
  modified_base (10)..(10): base is a locked nucleic acid
  modified_base (18)..(18): base is a locked nucleic acid
  misc_feature (32)..(38): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1175 - DNA, 34 bp, Artificial Sequence; identical to SEQ ID NO: 1130
  Pan degenerate oligonucleotide primer
  primer_bind (1)..(34)
  modified_base (1)..(1): base is a locked nucleic acid
  modified_base (12)..(12): base is a locked nucleic acid
  modified_base (13)..(13): base is a locked nucleic acid
  misc_feature (28)..(34): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1176 - DNA, 39 bp, Artificial Sequence; identical to SEQ ID NO: 1131
  Pan degenerate oligonucleotide primer
  primer_bind (1)..(39)
  modified_base (1)..(1): base is a locked nucleic acid
  modified_base (10)..(10): base is a locked nucleic acid
  modified_base (18)..(18): base is a locked nucleic acid
  misc_feature (33)..(39): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1177 - DNA, 38 bp, Artificial Sequence; identical to SEQ ID NO: 1129
  Pan degenerate oligonucleotide primer
  primer_bind (1)..(38)
  modified_base (1)..(1): base is a locked nucleic acid
  modified_base (7)..(7): base is a locked nucleic acid
  modified_base (10)..(10): base is a locked nucleic acid
  misc_feature (32)..(38): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1178 - DNA, 34 bp, Artificial Sequence; identical to SEQ ID NO: 1130
  Pan degenerate oligonucleotide primer
  primer_bind (1)..(34)
  modified_base (1)..(1): base is a locked nucleic acid
  modified_base (4)..(4): base is a locked nucleic acid
  modified_base (12)..(12): base is a locked nucleic acid
  misc_feature (28)..(34): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1179 - DNA, 39 bp, Artificial Sequence; identical to SEQ ID NO: 1131
  Pan degenerate oligonucleotide primer
  primer_bind (1)..(39)
  modified_base (1)..(1): base is a locked nucleic acid
  modified_base (7)..(7): base is a locked nucleic acid
  modified_base (10)..(10): base is a locked nucleic acid
  misc_feature (33)..(39): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1180 - DNA, 40 bp, Artificial Sequence; identical to SEQ ID NO: 1132
  Pan degenerate oligonucleotide primer
  primer_bind (1)..(40)
  modified_base (2)..(2): base is a locked nucleic acid
  modified_base (3)..(3): base is a locked nucleic acid
  modified_base (12)..(12): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1181 - DNA, 40 bp, Artificial Sequence; identical to SEQ ID NO: 1133
  Pan degenerate oligonucleotide primer
  primer_bind (1)..(40)
  modified_base (1)..(1): base is a locked nucleic acid
  modified_base (7)..(7): base is a locked nucleic acid
  modified_base (18)..(18): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1182 - DNA, 40 bp, Artificial Sequence; identical to SEQ ID NO: 1134
  Pan degenerate oligonucleotide primer
  primer_bind (1)..(40)
  modified_base (1)..(1): base is a locked nucleic acid
  modified_base (2)..(2): base is a locked nucleic acid
  modified_base (11)..(11): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1183 - DNA, 40 bp, Artificial Sequence; identical to SEQ ID NO: 1132
  Pan degenerate oligonucleotide primer
  primer_bind (1)..(40)
  modified_base (2)..(2): base is a locked nucleic acid
  modified_base (9)..(9): base is a locked nucleic acid
  modified_base (12)..(12): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1184 - DNA, 40 bp, Artificial Sequence; identical to SEQ ID NO: 1133
  Pan degenerate oligonucleotide primer
  primer_bind (1)..(40)
  modified_base (1)..(1): base is a locked nucleic acid
  modified_base (10)..(10): base is a locked nucleic acid
  modified_base (18)..(18): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1185 - DNA, 40 bp, Artificial Sequence; identical to SEQ ID NO: 1134
  Pan degenerate oligonucleotide primer
  primer_bind (1)..(40)
  modified_base (1)..(1): base is a locked nucleic acid
  modified_base (8)..(8): base is a locked nucleic acid
  modified_base (11)..(11): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1186 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (6)..(6): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
gggrytywcyacaccagayaa

SEQ ID NO: 1187 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (4)..(4): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagaya

SEQ ID NO: 1188 - DNA, 21 bp, Artificial Sequence
  Pan degenerate oligonucleotide primer
  primer_bind (1)..(21)
  modified_base (1)..(1): base is a locked nucleic acid
  modified_base (3)..(3): base is a locked nucleic acid
  modified_base (6)..(6): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
gggrytywcyacaccagayaa

SEQ ID NO: 1189 - DNA, 21 bp, Artificial Sequence
  Pan degenerate oligonucleotide primer
  primer_bind (1)..(21)
  modified_base (1)..(1): base is a locked nucleic acid
  modified_base (3)..(3): base is a locked nucleic acid
  modified_base (4)..(4): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagaya

SEQ ID NO: 1190 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (3)..(3): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
gggrytywcyacaccagayaa

SEQ ID NO: 1191 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (3)..(3): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagaya

SEQ ID NO: 1192 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (4)..(4): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagay

SEQ ID NO: 1193 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (4)..(4): base is a locked nucleic acid
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagayaa

SEQ ID NO: 1194 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (4)..(4): base is a locked nucleic acid
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagaya

SEQ ID NO: 1195 - DNA, 21 bp, Artificial Sequence
  Pan degenerate oligonucleotide primer
  primer_bind (1)..(21)
  modified_base (1)..(1): base is a locked nucleic acid
  modified_base (3)..(3): base is a locked nucleic acid
  modified_base (4)..(4): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagay

SEQ ID NO: 1196 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (4)..(4): base is a locked nucleic acid
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagayaa

SEQ ID NO: 1197 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (4)..(4): base is a locked nucleic acid
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagaya

SEQ ID NO: 1198 - DNA, 21 bp, Artificial Sequence
  Pan degenerate oligonucleotide primer
  primer_bind (1)..(21)
  modified_base (1)..(1): base is a locked nucleic acid
  modified_base (2)..(2): base is a locked nucleic acid
  modified_base (3)..(3): base is a locked nucleic acid
  misc_feature (15)..(21): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagay

SEQ ID NO: 1199 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (3)..(3): base is a locked nucleic acid
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
ggggrytywcyacaccagayaa

SEQ ID NO: 1200 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (3)..(3): base is a locked nucleic acid
  misc_feature (16)..(22): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagaya

SEQ ID NO: 1201 - DNA, 29 bp, Artificial Sequence
  Pan degenerate oligonucleotide primer
  primer_bind (1)..(29)
  modified_base (1)..(1): base is a locked nucleic acid
  modified_base (9)..(9): base is a locked nucleic acid
  modified_base (11)..(11): base is a locked nucleic acid
  misc_feature (23)..(29): Adaptor region of the pan degenerate sense primer that adapts the probe-binding site upstream of codon 219 to correspond to the nucleotides in an oligonucleotide probe upstream of the discriminating single nucleotide polymorphism.
trytrarvtggggrytywcyacaccagay

SEQ ID NO: 1202 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (4)..(4): base is a locked nucleic acid
  misc_feature (17)..(23): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagayaa

SEQ ID NO: 1203 - DNA, 30 bp, Artificial Sequence; identical to SEQ ID NO: 1142
  Pan degenerate oligonucleotide primer
  primer_bind (1)..(30)
  modified_base (1)..(1): base is a locked nucleic acid
  modified_base (9)..(9): base is a locked nucleic acid
  modified_base (11)..(11): base is a locked nucleic acid
  misc_feature (24)..(30): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1204 - DNA, 29 bp, Artificial Sequence
  Pan degenerate oligonucleotide primer
  primer_bind (1)..(29)
  modified_base (1)..(1): base is a locked nucleic acid
  modified_base (10)..(10): base is a locked nucleic acid
  modified_base (11)..(11): base is a locked nucleic acid
  misc_feature (23)..(29): Adaptor region of the pan degenerate sense primer that adapts the probe-binding site upstream of codon 219 to correspond to the nucleotides in an oligonucleotide probe upstream of the discriminating single nucleotide polymorphism.
trytrarvtggggrytywcyacaccagay

SEQ ID NO: 1205 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (4)..(4): base is a locked nucleic acid
  misc_feature (17)..(23): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagayaa

SEQ ID NO: 1206 - DNA, 30 bp, Artificial Sequence; identical to SEQ ID NO: 1142
  Pan degenerate oligonucleotide primer
  primer_bind (1)..(30)
  modified_base (1)..(1): base is a locked nucleic acid
  modified_base (10)..(10): base is a locked nucleic acid
  modified_base (11)..(11): base is a locked nucleic acid
  misc_feature (24)..(30): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1207 - DNA, 29 bp, Artificial Sequence
  Pan degenerate oligonucleotide primer
  primer_bind (1)..(29)
  modified_base (1)..(1): base is a locked nucleic acid
  modified_base (9)..(9): base is a locked nucleic acid
  modified_base (10)..(10): base is a locked nucleic acid
  misc_feature (23)..(29): Adaptor region of the pan degenerate sense primer that adapts the probe-binding site upstream of codon 219 to correspond to the nucleotides in an oligonucleotide probe upstream of the discriminating single nucleotide polymorphism.
trytrarvtggggrytywcyacaccagay

SEQ ID NO: 1208 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (3)..(3): base is a locked nucleic acid
  misc_feature (17)..(23): Adaptor region of the pan degenerate sense primer that adapts the probe-binding site upstream of codon 219 to correspond to the nucleotides in an oligonucleotide probe upstream of the discriminating single nucleotide polymorphism.
tggggrytywcyacaccagayaa

SEQ ID NO: 1209 - DNA, 30 bp, Artificial Sequence; identical to SEQ ID NO: 1142
  Pan degenerate oligonucleotide primer
  primer_bind (1)..(30)
  modified_base (1)..(1): base is a locked nucleic acid
  modified_base (9)..(9): base is a locked nucleic acid
  modified_base (10)..(10): base is a locked nucleic acid
  misc_feature (24)..(30): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1210 - DNA, 40 bp, Artificial Sequence; identical to SEQ ID NO: 1132
  Pan degenerate oligonucleotide primer
  primer_bind (1)..(40)
  modified_base (2)..(2): base is a locked nucleic acid
  modified_base (3)..(3): base is a locked nucleic acid
  modified_base (9)..(9): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1211 - DNA, 40 bp, Artificial Sequence; identical to SEQ ID NO: 1133
  Pan degenerate oligonucleotide primer
  primer_bind (1)..(40)
  modified_base (1)..(1): base is a locked nucleic acid
  modified_base (7)..(7): base is a locked nucleic acid
  modified_base (10)..(10): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1212 - DNA, 40 bp, Artificial Sequence; identical to SEQ ID NO: 1134
  Pan degenerate oligonucleotide primer
  primer_bind (1)..(40)
  modified_base (1)..(1): base is a locked nucleic acid
  modified_base (2)..(2): base is a locked nucleic acid
  modified_base (8)..(8): base is a locked nucleic acid
  misc_feature (34)..(40): Adaptor region of the pan degenerate sense primer that adapts the probe-binding site upstream of codon 219 to correspond to the nucleotides in an oligonucleotide probe upstream of the discriminating single nucleotide polymorphism.

SEQ ID NO: 1213 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 225 to correspond to the nucleotides in an oligonucleotide probe upstream of the discriminating single nucleotide polymorphism.
gggrytywcyacaccagayaaraarcatcaraargaac

SEQ ID NO: 1214 - DNA, 39 bp, Artificial Sequence
  Pan degenerate oligonucleotide primer
  primer_bind (1)..(39)
  misc_feature (33)..(39): Adaptor region of the pan degenerate sense primer that adapts the probe-binding site upstream of codon 225 to correspond to the nucleotides in an oligonucleotide probe upstream of the discriminating single nucleotide polymorphism.
ggggrytywcyacaccagayaaraarcatcaraargaac

SEQ ID NO: 1215 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 225 to correspond to the nucleotides in an oligonucleotide probe upstream of the discriminating single nucleotide polymorphism.
tggggrytywcyacaccagayaaraarcatcaraargaac

SEQ ID NO: 1216 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 225 to correspond to the nucleotides in an oligonucleotide probe upstream of the discriminating single nucleotide polymorphism.
tywcyacaccagayaaraarcatcaraargaac

SEQ ID NO: 1217 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 225 to correspond to the nucleotides in an oligonucleotide probe upstream of the discriminating single nucleotide polymorphism.
grytywcyacaccagayaaraarcatcaraargaac

SEQ ID NO: 1218 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 225 to correspond to the nucleotides in an oligonucleotide probe upstream of the discriminating single nucleotide polymorphism.
ggrytywcyacaccagayaaraarcatcaraargaac

SEQ ID NO: 1219 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 225 to correspond to the nucleotides in an oligonucleotide probe upstream of the discriminating single nucleotide polymorphism.
ytrarvtggggrytywmyacmccagayaaraarcatcaraaagaa

SEQ ID NO: 1220 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 225 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
gggrytywcyacaccagayaaraarcatcaraargaacn

SEQ ID NO: 1221 - DNA, 40 bp, Artificial Sequence
  Pan degenerate oligonucleotide primer
  primer_bind (1)..(40)
  misc_feature (33)..(39): Adaptor region of the pan degenerate sense primer that adapts the probe-binding site upstream of codon 225 to correspond to the nucleotides in an oligonucleotide probe upstream of the discriminating single nucleotide polymorphism.
  modified_base (40)..(40): base is a locked nucleic acid
  misc_feature (40)..(40): n is a, c, g, or t
ggggrytywcyacaccagayaaraarcatcaraargaacn

SEQ ID NO: 1222 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 225 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
tggggrytywcyacaccagayaaraarcatcaraargaacn

SEQ ID NO: 1223 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 225 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tywcyacaccagayaaraarcatcaraargaacn

SEQ ID NO: 1224 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 225 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
grytywcyacaccagayaaraarcatcaraargaacn

SEQ ID NO: 1225 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 225 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ggrytywcyacaccagayaaraarcatcaraargaacn

SEQ ID NO: 1226 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 225 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
ytrarvtggggrytywmyacmccagayaaraarcatcaraaagaan

SEQ ID NO: 1227 - DNA, 38 bp, Artificial Sequence; identical to SEQ ID NO: 1213
  Pan degenerate oligonucleotide primer
  primer_bind (1)..(38)
  modified_base (1)..(1): base is a locked nucleic acid
  modified_base (2)..(2): base is a locked nucleic acid
  modified_base (6)..(6): base is a locked nucleic acid
  misc_feature (32)..(38): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1228 - DNA, 38 bp, Artificial Sequence; identical to SEQ ID NO: 1213
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1229 - DNA, 38 bp, Artificial Sequence; identical to SEQ ID NO: 1213
  Pan degenerate oligonucleotide primer
  primer_bind (1)..(38)
  modified_base (1)..(1): base is a locked nucleic acid
  modified_base (2)..(2): base is a locked nucleic acid
  modified_base (3)..(3): base is a locked nucleic acid
  misc_feature (32)..(38): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1230 - DNA, 39 bp, Artificial Sequence; identical to SEQ ID NO: 1214
  Pan degenerate oligonucleotide primer
  primer_bind (1)..(39)
  modified_base (1)..(1): base is a locked nucleic acid
  modified_base (2)..(2): base is a locked nucleic acid
  modified_base (4)..(4): base is a locked nucleic acid
  misc_feature (33)..(39): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1231 - DNA, 39 bp, Artificial Sequence; identical to SEQ ID NO: 1214
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1232 - DNA, 39 bp, Artificial Sequence; identical to SEQ ID NO: 1214
  Pan degenerate oligonucleotide primer
  primer_bind (1)..(39)
  modified_base (1)..(1): base is a locked nucleic acid
  modified_base (2)..(2): base is a locked nucleic acid
  modified_base (3)..(3): base is a locked nucleic acid
  misc_feature (33)..(39): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1233 - DNA, 40 bp, Artificial Sequence; identical to SEQ ID NO: 1215
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1234 - DNA, 40 bp, Artificial Sequence; identical to SEQ ID NO: 1215
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1235 - DNA, 33 bp, Artificial Sequence; identical to SEQ ID NO: 1216
  Pan degenerate oligonucleotide primer
  primer_bind (1)..(33)
  modified_base (1)..(1): base is a locked nucleic acid
  modified_base (6)..(6): base is a locked nucleic acid
  modified_base (9)..(9): base is a locked nucleic acid
  misc_feature (27)..(33): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1236 - DNA, 33 bp, Artificial Sequence; identical to SEQ ID NO: 1216
  Pan degenerate oligonucleotide primer
  primer_bind (1)..(33)
  modified_base (1)..(1): base is a locked nucleic acid
  modified_base (7)..(7): base is a locked nucleic acid
  modified_base (9)..(9): base is a locked nucleic acid
  misc_feature (27)..(33): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1237 - DNA, 33 bp, Artificial Sequence; identical to SEQ ID NO: 1216
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (27)..(33): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1238 - DNA, 36 bp, Artificial Sequence; identical to SEQ ID NO: 1217
  Pan degenerate oligonucleotide primer
  primer_bind (1)..(36)
  modified_base (1)..(1): base is a locked nucleic acid
  modified_base (4)..(4): base is a locked nucleic acid
  modified_base (10)..(10): base is a locked nucleic acid
  misc_feature (30)..(36): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1239 - DNA, 36 bp, Artificial Sequence; identical to SEQ ID NO: 1217
  Pan degenerate oligonucleotide primer
  primer_bind (1)..(36)
  modified_base (1)..(1): base is a locked nucleic acid
  modified_base (9)..(9): base is a locked nucleic acid
  modified_base (10)..(10): base is a locked nucleic acid
  misc_feature (30)..(36): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1240 - DNA, 36 bp, Artificial Sequence; identical to SEQ ID NO: 1217
  Pan degenerate oligonucleotide primer
  primer_bind (1)..(36)
  modified_base (1)..(1): base is a locked nucleic acid
  modified_base (4)..(4): base is a locked nucleic acid
  modified_base (9)..(9): base is a locked nucleic acid
  misc_feature (30)..(36): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1241 - DNA, 37 bp, Artificial Sequence; identical to SEQ ID NO: 1218
  Pan degenerate oligonucleotide primer
  primer_bind (1)..(37)
  modified_base (1)..(1): base is a locked nucleic acid
  modified_base (2)..(2): base is a locked nucleic acid
  modified_base (10)..(10): base is a locked nucleic acid
  misc_feature (31)..(37): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1242 - DNA, 37 bp, Artificial Sequence; identical to SEQ ID NO: 1218
  Pan degenerate oligonucleotide primer
  primer_bind (1)..(37)
  modified_base (1)..(1): base is a locked nucleic acid
  modified_base (5)..(5): base is a locked nucleic acid
  modified_base (10)..(10): base is a locked nucleic acid
  misc_feature (31)..(37): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1243 - DNA, 37 bp, Artificial Sequence; identical to SEQ ID NO: 1218
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1244 - DNA, 40 bp, Artificial Sequence; identical to SEQ ID NO: 1215
  Pan degenerate oligonucleotide primer
  primer_bind (1)..(40)
  modified_base (1)..(1): base is a locked nucleic acid
  modified_base (2)..(2): base is a locked nucleic acid
  modified_base (3)..(3): base is a locked nucleic acid
  misc_feature (34)..(40): Adaptor region of the pan degenerate sense primer that adapts the probe-binding site upstream of codon 225 to correspond to the nucleotides in an oligonucleotide probe upstream of the discriminating single nucleotide polymorphism.

SEQ ID NO: 1245 - DNA, 32 bp, Artificial Sequence
  Pan degenerate oligonucleotide primer
  primer_bind (1)..(32)
  misc_feature (26)..(32): Adaptor region of the pan degenerate sense primer that adapts the probe-binding site upstream of codon 227 to correspond to the nucleotides in an oligonucleotide probe upstream of the discriminating single nucleotide polymorphism.
caccagayaaraarcatcaraargaaccycca

SEQ ID NO: 1246 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.
caccagayaaraarcatcaraargaaccyccat

SEQ ID NO: 1247 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.
acaccagayaaraarcatcaraargaaccycca

SEQ ID NO: 1248 - DNA, 34 bp, Artificial Sequence
  Pan degenerate oligonucleotide primer
  primer_bind (1)..(34)
  misc_feature (28)..(34): Adaptor region of the pan degenerate sense primer that adapts the probe-binding site upstream of codon 227 to correspond to the nucleotides in an oligonucleotide probe upstream of the discriminating single nucleotide polymorphism.
acaccagayaaraarcatcaraargaaccyccat

SEQ ID NO: 1249 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.
rytywcyacaccagayaaraarcatcaraargaaccycca

SEQ ID NO: 1250 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.
ytywcyacaccagayaaraarcatcaraargaaccyccat

SEQ ID NO: 1251 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccycca

SEQ ID NO: 1252 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccyccat

SEQ ID NO: 1253 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 227 to correspond to the nucleotides in an oligonucleotide probe upstream of the discriminating single nucleotide polymorphism.
cagayaaraarcatcaraargaaccycca

SEQ ID NO: 1254 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.
cagayaaraarcatcaraargaaccyccat

SEQ ID NO: 1255 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.
ccagayaaraarcatcaraargaaccycca

SEQ ID NO: 1256 - DNA, 31 bp, Artificial Sequence
  Pan degenerate oligonucleotide primer
  primer_bind (1)..(31)
  misc_feature (25)..(31): Adaptor region of the pan degenerate sense primer that adapts the probe-binding site upstream of codon 227 to correspond to the nucleotides in an oligonucleotide probe upstream of the discriminating single nucleotide polymorphism.
ccagayaaraarcatcaraargaaccyccat

SEQ ID NO: 1257 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 227 to correspond to the nucleotides in an oligonucleotide probe upstream of the discriminating single nucleotide polymorphism.
tggggrytywmyacmccagayaaraarcatcaraargaacctcca

SEQ ID NO: 1258 - DNA, 33 bp, Artificial Sequence
  Pan degenerate oligonucleotide primer
  primer_bind (1)..(33)
  misc_feature (26)..(32): Adaptor region of the pan degenerate sense primer that adapts the probe-binding site upstream of codon 227 to correspond to the nucleotides in an oligonucleotide probe upstream of the discriminating single nucleotide polymorphism.
  modified_base (33)..(33): base is a locked nucleic acid
  misc_feature (33)..(33): n is a, c, g, or t
caccagayaaraarcatcaraargaaccyccan

SEQ ID NO: 1259 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
caccagayaaraarcatcaraargaaccyccatn

SEQ ID NO: 1260 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
acaccagayaaraarcatcaraargaaccyccan

SEQ ID NO: 1261 - DNA, 35 bp, Artificial Sequence
  Pan degenerate oligonucleotide primer
  primer_bind (1)..(35)
  misc_feature (28)..(34): Adaptor region of the pan degenerate sense primer that adapts the probe-binding site upstream of codon 227 to correspond to the nucleotides in an oligonucleotide probe upstream of the discriminating single nucleotide polymorphism.
  modified_base (35)..(35): base is a locked nucleic acid
  misc_feature (35)..(35): n is a, c, g, or t
acaccagayaaraarcatcaraargaaccyccatn

SEQ ID NO: 1262 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
rytywcyacaccagayaaraarcatcaraargaaccyccan

SEQ ID NO: 1263 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ytywcyacaccagayaaraarcatcaraargaaccyccatn

SEQ ID NO: 1264 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 227 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
gayaaraarcatcaraargaaccyccan

SEQ ID NO: 1265 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 227 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
gayaaraarcatcaraargaaccyccatn

SEQ ID NO: 1266 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 227 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
cagayaaraarcatcaraargaaccyccan

SEQ ID NO: 1267 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
cagayaaraarcatcaraargaaccyccatn

SEQ ID NO: 1268 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
ccagayaaraarcatcaraargaaccyccan

SEQ ID NO: 1269 - DNA, 32 bp, Artificial Sequence
  Pan degenerate oligonucleotide primer
  primer_bind (1)..(32)
  misc_feature (25)..(31): Adaptor region of the pan degenerate sense primer that adapts the probe-binding site upstream of codon 227 to correspond to the nucleotides in an oligonucleotide probe upstream of the discriminating single nucleotide polymorphism.
  modified_base (32)..(32): base is a locked nucleic acid
  misc_feature (32)..(32): n is a, c, g, or t
ccagayaaraarcatcaraargaaccyccatn

SEQ ID NO: 1270 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 227 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
tggggrytywmyacmccagayaaraarcatcaraargaacctccan

SEQ ID NO: 1271 - DNA, 32 bp, Artificial Sequence; identical to SEQ ID NO: 1245
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1272 - DNA, 33 bp, Artificial Sequence; identical to SEQ ID NO: 1246
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1273 - DNA, 32 bp, Artificial Sequence; identical to SEQ ID NO: 1245
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1274 - DNA, 33 bp, Artificial Sequence; identical to SEQ ID NO: 1246
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1275 - DNA, 32 bp, Artificial Sequence; identical to SEQ ID NO: 1245
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1276 - DNA, 33 bp, Artificial Sequence; identical to SEQ ID NO: 1246
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1277 - DNA, 33 bp, Artificial Sequence; identical to SEQ ID NO: 1247
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1278 - DNA, 34 bp, Artificial Sequence; identical to SEQ ID NO: 1248
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1279 - DNA, 33 bp, Artificial Sequence; identical to SEQ ID NO: 1247
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1280 - DNA, 34 bp, Artificial Sequence; identical to SEQ ID NO: 1248
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1281 - DNA, 33 bp, Artificial Sequence; identical to SEQ ID NO: 1247
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1282 - DNA, 34 bp, Artificial Sequence; identical to SEQ ID NO: 1248
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1283 - DNA, 40 bp, Artificial Sequence; identical to SEQ ID NO: 1249
  Pan degenerate oligonucleotide primer
  primer_bind (1)..(40)
  modified_base (3)..(3): base is a locked nucleic acid
  modified_base (8)..(8): base is a locked nucleic acid
  modified_base (11)..(11): base is a locked nucleic acid
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1284 - DNA, 40 bp, Artificial Sequence; identical to SEQ ID NO: 1250
  Pan degenerate oligonucleotide primer
  primer_bind (1)..(40)
  modified_base (2)..(2): base is a locked nucleic acid
  modified_base (7)..(7): base is a locked nucleic acid
  modified_base (10)..(10): base is a locked nucleic acid
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1285 - DNA, 40 bp, Artificial Sequence; identical to SEQ ID NO: 1249
  Pan degenerate oligonucleotide primer
  primer_bind (1)..(40)
  modified_base (3)..(3): base is a locked nucleic acid
  modified_base (9)..(9): base is a locked nucleic acid
  modified_base (11)..(11): base is a locked nucleic acid
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1286 - DNA, 40 bp, Artificial Sequence; identical to SEQ ID NO: 1250
  Pan degenerate oligonucleotide primer
  primer_bind (1)..(40)
  modified_base (2)..(2): base is a locked nucleic acid
  modified_base (8)..(8): base is a locked nucleic acid
  modified_base (10)..(10): base is a locked nucleic acid
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1287 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (8)..(8): base is a locked nucleic acid
  misc_feature (21)..(27): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccycca

SEQ ID NO: 1288 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (8)..(8): base is a locked nucleic acid
  misc_feature (22)..(28): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccyccat

SEQ ID NO: 1289 - DNA, 27 bp, Artificial Sequence
  Pan degenerate oligonucleotide primer
  primer_bind (1)..(27)
  modified_base (1)..(1): base is a locked nucleic acid
  modified_base (7)..(7): base is a locked nucleic acid
  modified_base (8)..(8): base is a locked nucleic acid
  misc_feature (21)..(27): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccycca

SEQ ID NO: 1290 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (8)..(8): base is a locked nucleic acid
  misc_feature (22)..(28): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccyccat

SEQ ID NO: 1291 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (7)..(7): base is a locked nucleic acid
  misc_feature (21)..(27): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccycca

SEQ ID NO: 1292 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (7)..(7): base is a locked nucleic acid
  misc_feature (22)..(28): Adaptor region of the pan degenerate sense primer that adapts the probe-binding site upstream of codon 227 to correspond to the nucleotides in an oligonucleotide probe upstream of the discriminating single nucleotide polymorphism.
gayaaraarcatcaraargaaccyccat

SEQ ID NO: 1293 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (9)..(9): base is a locked nucleic acid
  misc_feature (23)..(29): Adaptor region of the pan degenerate sense primer that adapts the probe-binding site upstream of codon 227 to correspond to the nucleotides in an oligonucleotide probe upstream of the discriminating single nucleotide polymorphism.
cagayaaraarcatcaraargaaccycca

SEQ ID NO: 1294 - DNA, 30 bp, Artificial Sequence; identical to SEQ ID NO: 1254
  Pan degenerate oligonucleotide primer
  primer_bind (1)..(30)
  modified_base (1)..(1): base is a locked nucleic acid
  modified_base (3)..(3): base is a locked nucleic acid
  modified_base (9)..(9): base is a locked nucleic acid
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1295 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (9)..(9): base is a locked nucleic acid
  misc_feature (23)..(29): Adaptor region of the pan degenerate sense primer that adapts the probe-binding site upstream of codon 227 to correspond to the nucleotides in an oligonucleotide probe upstream of the discriminating single nucleotide polymorphism.
cagayaaraarcatcaraargaaccycca

SEQ ID NO: 1296 - DNA, 30 bp, Artificial Sequence; identical to SEQ ID NO: 1254
  Pan degenerate oligonucleotide primer
  primer_bind (1)..(30)
  modified_base (1)..(1): base is a locked nucleic acid
  modified_base (4)..(4): base is a locked nucleic acid
  modified_base (9)..(9): base is a locked nucleic acid
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1297 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate sense primer that adapts the probe-binding site upstream of codon 227 to correspond to the nucleotides in an oligonucleotide probe upstream of the discriminating single nucleotide polymorphism.
cagayaaraarcatcaraargaaccycca

SEQ ID NO: 1298 - DNA, 30 bp, Artificial Sequence; identical to SEQ ID NO: 1254
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1299 - DNA, 30 bp, Artificial Sequence; identical to SEQ ID NO: 1255
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1300 - DNA, 31 bp, Artificial Sequence; identical to SEQ ID NO: 1256
  Pan degenerate oligonucleotide primer
  primer_bind (1)..(31)
  modified_base (1)..(1): base is a locked nucleic acid
  modified_base (2)..(2): base is a locked nucleic acid
  modified_base (5)..(5): base is a locked nucleic acid
  misc_feature (25)..(31): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1301 - DNA, 30 bp, Artificial Sequence; identical to SEQ ID NO: 1255
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1302 - DNA, 31 bp, Artificial Sequence; identical to SEQ ID NO: 1256
  Pan degenerate oligonucleotide primer
  primer_bind (1)..(31)
  modified_base (1)..(1): base is a locked nucleic acid
  modified_base (4)..(4): base is a locked nucleic acid
  modified_base (5)..(5): base is a locked nucleic acid
  misc_feature (25)..(31): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1303 - DNA, 30 bp, Artificial Sequence; identical to SEQ ID NO: 1255
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1304 - DNA, 31 bp, Artificial Sequence; identical to SEQ ID NO: 1256
  Pan degenerate oligonucleotide primer
  primer_bind (1)..(31)
  modified_base (1)..(1): base is a locked nucleic acid
  modified_base (2)..(2): base is a locked nucleic acid
  modified_base (4)..(4): base is a locked nucleic acid
  misc_feature (25)..(31): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1305 - DNA, 40 bp, Artificial Sequence; identical to SEQ ID NO: 1249
  Pan degenerate oligonucleotide primer
  primer_bind (1)..(40)
  modified_base (3)..(3): base is a locked nucleic acid
  modified_base (8)..(8): base is a locked nucleic acid
  modified_base (9)..(9): base is a locked nucleic acid
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1306 - DNA, 40 bp, Artificial Sequence; identical to SEQ ID NO: 1250
  Pan degenerate oligonucleotide primer
  primer_bind (1)..(40)
  modified_base (2)..(2): base is a locked nucleic acid
  modified_base (7)..(7): base is a locked nucleic acid
  modified_base (8)..(8): base is a locked nucleic acid
  misc_feature (34)..(40): Adaptor region of the pan degenerate sense primer that adapts the probe-binding site upstream of codon 227 to correspond to the nucleotides in an oligonucleotide probe upstream of the discriminating single nucleotide polymorphism.

SEQ ID NO: 1307 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 230 to correspond to the nucleotides in an oligonucleotide probe upstream of the discriminating single nucleotide polymorphism.
gayaaraarcatcaraargaaccyccattyctttgg

SEQ ID NO: 1308 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 230 to correspond to the nucleotides in an oligonucleotide probe upstream of the discriminating single nucleotide polymorphism.
cagayaaraarcatcaraargaaccyccattyctttgg

SEQ ID NO: 1309 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.
accagayaaraarcatcaraargaaccyccattyctttgg

SEQ ID NO: 1310 - DNA, 29 bp, Artificial Sequence
  Pan degenerate oligonucleotide primer
  primer_bind (1)..(29)
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
arcatcaraargaaccyccattyctttgg

SEQ ID NO: 1311 - DNA, 30 bp, Artificial Sequence
  Pan degenerate oligonucleotide primer
  primer_bind (1)..(30)
  misc_feature (24)..(30): Adaptor region of the pan degenerate sense primer that adapts the probe-binding site upstream of codon 230 to correspond to the nucleotides in an oligonucleotide probe upstream of the discriminating single nucleotide polymorphism.
aarcatcaraargaaccyccattyctttgg

SEQ ID NO: 1312 - DNA, 35 bp, Artificial Sequence
  Pan degenerate oligonucleotide primer
  primer_bind (1)..(35)
  misc_feature (29)..(35): Adaptor region of the pan degenerate sense primer that adapts the probe-binding site upstream of codon 230 to correspond to the nucleotides in an oligonucleotide probe upstream of the discriminating single nucleotide polymorphism.
ayaaraarcatcaraargaaccyccattyctttgg

SEQ ID NO: 1313 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 230 to correspond to the nucleotides in an oligonucleotide probe upstream of the discriminating single nucleotide polymorphism.
wmyacmccagayaaraarcatcaraargaaccyccattcctttgg

SEQ ID NO: 1314 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 230 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
gayaaraarcatcaraargaaccyccattyctttggn

SEQ ID NO: 1315 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 230 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
cagayaaraarcatcaraargaaccyccattyctttggn

SEQ ID NO: 1316 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
accagayaaraarcatcaraargaaccyccattyctttggn

SEQ ID NO: 1317 - DNA, 30 bp, Artificial Sequence
  Pan degenerate oligonucleotide primer
  primer_bind (1)..(30)
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
  modified_base (30)..(30): base is a locked nucleic acid
  misc_feature (30)..(30): n is a, c, g, or t
arcatcaraargaaccyccattyctttggn

SEQ ID NO: 1318 - DNA, 31 bp, Artificial Sequence
  Pan degenerate oligonucleotide primer
  primer_bind (1)..(31)
  misc_feature (24)..(30): Adaptor region of the pan degenerate sense primer that adapts the probe-binding site upstream of codon 230 to correspond to the nucleotides in an oligonucleotide probe upstream of the discriminating single nucleotide polymorphism.
  modified_base (31)..(31): base is a locked nucleic acid
  misc_feature (31)..(31): n is a, c, g, or t
aarcatcaraargaaccyccattyctttggn

SEQ ID NO: 1319 - DNA, 36 bp, Artificial Sequence
  Pan degenerate oligonucleotide primer
  primer_bind (1)..(36)
  misc_feature (29)..(35): Adaptor region of the pan degenerate sense primer that adapts the probe-binding site upstream of codon 230 to correspond to the nucleotides in an oligonucleotide probe upstream of the discriminating single nucleotide polymorphism.
  modified_base (36)..(36): base is a locked nucleic acid
  misc_feature (36)..(36): n is a, c, g, or t
ayaaraarcatcaraargaaccyccattyctttggn

SEQ ID NO: 1320 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 230 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
wmyacmccagayaaraarcatcaraargaaccyccattcctttggn

SEQ ID NO: 1321 - DNA, 36 bp, Artificial Sequence; identical to SEQ ID NO: 1307
  Pan degenerate oligonucleotide primer
  primer_bind (1)..(36)
  modified_base (1)..(1): base is a locked nucleic acid
  modified_base (2)..(2): base is a locked nucleic acid
  modified_base (8)..(8): base is a locked nucleic acid
  misc_feature (30)..(36): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1322 - DNA, 36 bp, Artificial Sequence; identical to SEQ ID NO: 1307
  Pan degenerate oligonucleotide primer
  primer_bind (1)..(36)
  modified_base (1)..(1): base is a locked nucleic acid
  modified_base (7)..(7): base is a locked nucleic acid
  modified_base (8)..(8): base is a locked nucleic acid
  misc_feature (30)..(36): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1323 - DNA, 36 bp, Artificial Sequence; identical to SEQ ID NO: 1307
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (30)..(36): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1324 - DNA, 38 bp, Artificial Sequence; identical to SEQ ID NO: 1308
  Pan degenerate oligonucleotide primer
  primer_bind (1)..(38)
  modified_base (1)..(1): base is a locked nucleic acid
  modified_base (3)..(3): base is a locked nucleic acid
  modified_base (9)..(9): base is a locked nucleic acid
  misc_feature (32)..(38): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1325 - DNA, 38 bp, Artificial Sequence; identical to SEQ ID NO: 1308
  Pan degenerate oligonucleotide primer
  primer_bind (1)..(38)
  modified_base (1)..(1): base is a locked nucleic acid
  modified_base (4)..(4): base is a locked nucleic acid
  modified_base (9)..(9): base is a locked nucleic acid
  misc_feature (32)..(38): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1326 - DNA, 38 bp, Artificial Sequence; identical to SEQ ID NO: 1308
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1327 - DNA, 40 bp, Artificial Sequence; identical to SEQ ID NO: 1309
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1328 - DNA, 40 bp, Artificial Sequence; identical to SEQ ID NO: 1309
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1329 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
arcatcaraargaaccyccattyctttgg

SEQ ID NO: 1330 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
arcatcaraargaaccyccattyctttgg

SEQ ID NO: 1331 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate sense primer that adapts the probe-binding site upstream of codon 230 to correspond to the nucleotides in an oligonucleotide probe upstream of the discriminating single nucleotide polymorphism.
arcatcaraargaaccyccattyctttgg

SEQ ID NO: 1332 - DNA, 30 bp, Artificial Sequence; identical to SEQ ID NO: 1311
  Pan degenerate oligonucleotide primer
  primer_bind (1)..(30)
  modified_base (1)..(1): base is a locked nucleic acid
  modified_base (2)..(2): base is a locked nucleic acid
  modified_base (7)..(7): base is a locked nucleic acid
  misc_feature (24)..(30): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1333 - DNA, 30 bp, Artificial Sequence; identical to SEQ ID NO: 1311
  Pan degenerate oligonucleotide primer
  primer_bind (1)..(30)
  modified_base (1)..(1): base is a locked nucleic acid
  modified_base (5)..(5): base is a locked nucleic acid
  modified_base (7)..(7): base is a locked nucleic acid
  misc_feature (24)..(30): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1334 - DNA, 30 bp, Artificial Sequence; identical to SEQ ID NO: 1311
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1335 - DNA, 35 bp, Artificial Sequence; identical to SEQ ID NO: 1312
  Pan degenerate oligonucleotide primer
  primer_bind (1)..(35)
  modified_base (1)..(1): base is a locked nucleic acid
  modified_base (6)..(6): base is a locked nucleic acid
  modified_base (10)..(10): base is a locked nucleic acid
  misc_feature (29)..(35): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1336 - DNA, 35 bp, Artificial Sequence; identical to SEQ ID NO: 1312
  Pan degenerate oligonucleotide primer
  primer_bind (1)..(35)
  modified_base (1)..(1): base is a locked nucleic acid
  modified_base (7)..(7): base is a locked nucleic acid
  modified_base (10)..(10): base is a locked nucleic acid
  misc_feature (29)..(35): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1337 - DNA, 35 bp, Artificial Sequence; identical to SEQ ID NO: 1312
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1338 - DNA, 40 bp, Artificial Sequence; identical to SEQ ID NO: 1309
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate sense primer that adapts the probe-binding site upstream of codon 230 to correspond to the nucleotides in an oligonucleotide probe upstream of the discriminating single nucleotide polymorphism.

SEQ ID NO: 1339 - DNA, 36 bp, Artificial Sequence
  Pan degenerate oligonucleotide primer
  primer_bind (1)..(36)
  misc_feature (30)..(36): Adaptor region of the pan degenerate sense primer that adapts the probe-binding site upstream of codon 238 to correspond to the nucleotides in an oligonucleotide probe upstream of the discriminating single nucleotide polymorphism.
cattyctttggatgggdtatgarctccatcctgaya

SEQ ID NO: 1340 - DNA, 37 bp, Artificial Sequence
  Pan degenerate oligonucleotide primer
  primer_bind (1)..(37)
  misc_feature (31)..(37): Adaptor region of the pan degenerate sense primer that adapts the probe-binding site upstream of codon 238 to correspond to the nucleotides in an oligonucleotide probe upstream of the discriminating single nucleotide polymorphism.
ccattyctttggatgggdtatgarctccatcctgaya

SEQ ID NO: 1341 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 238 to correspond to the nucleotides in an oligonucleotide probe upstream of the discriminating single nucleotide polymorphism.
ccyccattyctttggatgggdtatgarctccatcctgaya

SEQ ID NO: 1342 - DNA, 27 bp, Artificial Sequence
  Pan degenerate oligonucleotide primer
  primer_bind (1)..(27)
  misc_feature (21)..(27): Adaptor region of the pan degenerate sense primer that adapts the probe-binding site upstream of codon 238 to correspond to the nucleotides in an oligonucleotide probe upstream of the discriminating single nucleotide polymorphism.
ggatgggdtatgarctccatcctgaya

SEQ ID NO: 1343 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 238 to correspond to the nucleotides in an oligonucleotide probe upstream of the discriminating single nucleotide polymorphism.
tggatgggdtatgarctccatcctgaya

SEQ ID NO: 1344 - DNA, 33 bp, Artificial Sequence
  Pan degenerate oligonucleotide primer
  primer_bind (1)..(33)
  misc_feature (27)..(33): Adaptor region of the pan degenerate sense primer that adapts the probe-binding site upstream of codon 238 to correspond to the nucleotides in an oligonucleotide probe upstream of the discriminating single nucleotide polymorphism.
tyctttggatgggdtatgarctccatcctgaya

SEQ ID NO: 1345 - DNA, 45 bp, Artificial Sequence
  Pan degenerate oligonucleotide primer
  primer_bind (1)..(45)
  misc_feature (39)..(45): Adaptor region of the pan degenerate sense primer that adapts the probe-binding site upstream of codon 238 to correspond to the nucleotides in an oligonucleotide probe upstream of the discriminating single nucleotide polymorphism.
aargaaccyccattyctytggatgggdtatgarctccatcctgat

SEQ ID NO: 1346 - DNA, 37 bp, Artificial Sequence
  Pan degenerate oligonucleotide primer
  primer_bind (1)..(37)
  misc_feature (30)..(36): Adaptor region of the pan degenerate sense primer that adapts the probe-binding site upstream of codon 238 to correspond to the nucleotides in an oligonucleotide probe upstream of the discriminating single nucleotide polymorphism.
  modified_base (37)..(37): base is a locked nucleic acid
  misc_feature (37)..(37): n is a, c, g, or t
cattyctttggatgggdtatgarctccatcctgayan

SEQ ID NO: 1347 - DNA, 38 bp, Artificial Sequence
  Pan degenerate oligonucleotide primer
  primer_bind (1)..(38)
  misc_feature (31)..(37): Adaptor region of the pan degenerate sense primer that adapts the probe-binding site upstream of codon 238 to correspond to the nucleotides in an oligonucleotide probe upstream of the discriminating single nucleotide polymorphism.
  modified_base (38)..(38): base is a locked nucleic acid
  misc_feature (38)..(38): n is a, c, g, or t
ccattyctttggatgggdtatgarctccatcctgayan

SEQ ID NO: 1348 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 238 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
ccyccattyctttggatgggdtatgarctccatcctgayan

SEQ ID NO: 1349 - DNA, 28 bp, Artificial Sequence
  Pan degenerate oligonucleotide primer
  primer_bind (1)..(28)
  misc_feature (21)..(27): Adaptor region of the pan degenerate sense primer that adapts the probe-binding site upstream of codon 238 to correspond to the nucleotides in an oligonucleotide probe upstream of the discriminating single nucleotide polymorphism.
  modified_base (28)..(28): base is a locked nucleic acid
  misc_feature (28)..(28): n is a, c, g, or t
ggatgggdtatgarctccatcctgayan

SEQ ID NO: 1350 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 238 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
tggatgggdtatgarctccatcctgayan

SEQ ID NO: 1351 - DNA, 34 bp, Artificial Sequence
  Pan degenerate oligonucleotide primer
  primer_bind (1)..(34)
  misc_feature (27)..(33): Adaptor region of the pan degenerate sense primer that adapts the probe-binding site upstream of codon 238 to correspond to the nucleotides in an oligonucleotide probe upstream of the discriminating single nucleotide polymorphism.
  modified_base (34)..(34): base is a locked nucleic acid
  misc_feature (34)..(34): n is a, c, g, or t
tyctttggatgggdtatgarctccatcctgayan

SEQ ID NO: 1352 - DNA, 46 bp, Artificial Sequence
  Pan degenerate oligonucleotide primer
  primer_bind (1)..(46)
  misc_feature (39)..(45): Adaptor region of the pan degenerate sense primer that adapts the probe-binding site upstream of codon 238 to correspond to the nucleotides in an oligonucleotide probe upstream of the discriminating single nucleotide polymorphism.
  modified_base (46)..(46): base is a locked nucleic acid
  misc_feature (46)..(46): n is a, c, g, or t
aargaaccyccattyctytggatgggdtatgarctccatcctgatn

SEQ ID NO: 1353 - DNA, 36 bp, Artificial Sequence; identical to SEQ ID NO: 1339
  Pan degenerate oligonucleotide primer
  primer_bind (1)..(36)
  modified_base (1)..(1): base is a locked nucleic acid
  modified_base (4)..(4): base is a locked nucleic acid
  modified_base (10)..(10): base is a locked nucleic acid
  misc_feature (30)..(36): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1354 - DNA, 36 bp, Artificial Sequence; identical to SEQ ID NO: 1339
  Pan degenerate oligonucleotide primer
  primer_bind (1)..(36)
  modified_base (1)..(1): base is a locked nucleic acid
  modified_base (9)..(9): base is a locked nucleic acid
  modified_base (10)..(10): base is a locked nucleic acid
  misc_feature (30)..(36): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1355 - DNA, 36 bp, Artificial Sequence; identical to SEQ ID NO: 1339
  Pan degenerate oligonucleotide primer
  primer_bind (1)..(36)
  modified_base (1)..(1): base is a locked nucleic acid
  modified_base (4)..(4): base is a locked nucleic acid
  modified_base (9)..(9): base is a locked nucleic acid
  misc_feature (30)..(36): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1356 - DNA, 37 bp, Artificial Sequence; identical to SEQ ID NO: 1340
  Pan degenerate oligonucleotide primer
  primer_bind (1)..(37)
  modified_base (1)..(1): base is a locked nucleic acid
  modified_base (2)..(2): base is a locked nucleic acid
  modified_base (10)..(10): base is a locked nucleic acid
  misc_feature (31)..(37): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1357 - DNA, 37 bp, Artificial Sequence; identical to SEQ ID NO: 1340
  Pan degenerate oligonucleotide primer
  primer_bind (1)..(37)
  modified_base (1)..(1): base is a locked nucleic acid
  modified_base (5)..(5): base is a locked nucleic acid
  modified_base (10)..(10): base is a locked nucleic acid
  misc_feature (31)..(37): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1358 - DNA, 37 bp, Artificial Sequence; identical to SEQ ID NO: 1340
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1359 - DNA, 40 bp, Artificial Sequence; identical to SEQ ID NO: 1341
  Pan degenerate oligonucleotide primer
  primer_bind (1)..(40)
  modified_base (1)..(1): base is a locked nucleic acid
  modified_base (4)..(4): base is a locked nucleic acid
  modified_base (8)..(8): base is a locked nucleic acid
  misc_feature (34)..(40): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1360 - DNA, 40 bp, Artificial Sequence; identical to SEQ ID NO: 1341
  Pan degenerate oligonucleotide primer
  primer_bind (1)..(40)
  modified_base (1)..(1): base is a locked nucleic acid
  modified_base (5)..(5): base is a locked nucleic acid
  modified_base (8)..(8): base is a locked nucleic acid
  misc_feature (34)..(40): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1361 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate sense primer that adapts the probe-binding site upstream of codon 238 to correspond to the nucleotides in an oligonucleotide probe upstream of the discriminating single nucleotide polymorphism.
ggatgggdtatgarctccatcctgaya

SEQ ID NO: 1362 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate sense primer that adapts the probe-binding site upstream of codon 238 to correspond to the nucleotides in an oligonucleotide probe upstream of the discriminating single nucleotide polymorphism.
ggatgggdtatgarctccatcctgaya

SEQ ID NO: 1363 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (4)..(4): base is a locked nucleic acid
  misc_feature (21)..(27): Adaptor region of the pan degenerate sense primer that adapts the probe-binding site upstream of codon 238 to correspond to the nucleotides in an oligonucleotide probe upstream of the discriminating single nucleotide polymorphism.
ggatgggdtatgarctccatcctgaya

SEQ ID NO: 1364 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (5)..(5): base is a locked nucleic acid
  misc_feature (22)..(28): Adaptor region of the pan degenerate sense primer that adapts the probe-binding site upstream of codon 238 to correspond to the nucleotides in an oligonucleotide probe upstream of the discriminating single nucleotide polymorphism.
tggatgggdtatgarctccatcctgaya

SEQ ID NO: 1365 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (5)..(5): base is a locked nucleic acid
  misc_feature (22)..(28): Adaptor region of the pan degenerate sense primer that adapts the probe-binding site upstream of codon 238 to correspond to the nucleotides in an oligonucleotide probe upstream of the discriminating single nucleotide polymorphism.
tggatgggdtatgarctccatcctgaya

SEQ ID NO: 1366 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (3)..(3): base is a locked nucleic acid
  misc_feature (22)..(28): Adaptor region of the pan degenerate sense primer that adapts the probe-binding site upstream of codon 238 to correspond to the nucleotides in an oligonucleotide probe upstream of the discriminating single nucleotide polymorphism.
tggatgggdtatgarctccatcctgaya

SEQ ID NO: 1367 - DNA, 33 bp, Artificial Sequence; identical to SEQ ID NO: 1344
  Pan degenerate oligonucleotide primer
  primer_bind (1)..(33)
  modified_base (1)..(1): base is a locked nucleic acid
  modified_base (6)..(6): base is a locked nucleic acid
  modified_base (8)..(8): base is a locked nucleic acid
  misc_feature (27)..(33): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1368 - DNA, 33 bp, Artificial Sequence; identical to SEQ ID NO: 1344
  Pan degenerate oligonucleotide primer
  primer_bind (1)..(33)
  modified_base (1)..(1): base is a locked nucleic acid
  modified_base (7)..(7): base is a locked nucleic acid
  modified_base (8)..(8): base is a locked nucleic acid
  misc_feature (27)..(33): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1369 - DNA, 33 bp, Artificial Sequence; identical to SEQ ID NO: 1344
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (27)..(33): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1370 - DNA, 40 bp, Artificial Sequence; identical to SEQ ID NO: 1341
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate sense primer that adapts the probe-binding site upstream of codon 238 to correspond to the nucleotides in an oligonucleotide probe upstream of the discriminating single nucleotide polymorphism.

SEQ ID NO: 1371 - DNA, 28 bp, Artificial Sequence
  Pan degenerate oligonucleotide primer
  primer_bind (1)..(28)
  misc_feature (22)..(28): Adaptor region of the pan degenerate sense primer that adapts the probe-binding site upstream of codon 318 to correspond to the nucleotides in an oligonucleotide probe upstream of the discriminating single nucleotide polymorphism.
ttytaararmmccwgtrcatggrgyvta

SEQ ID NO: 1372 - DNA, 38 bp, Artificial Sequence
  Pan degenerate oligonucleotide primer
  primer_bind (1)..(38)
  misc_feature (32)..(38): Adaptor region of the pan degenerate sense primer that adapts the probe-binding site upstream of codon 318 to correspond to the nucleotides in an oligonucleotide probe upstream of the discriminating single nucleotide polymorphism.
aayagrgarattytaararmmccwgtrcatggrgyvta

SEQ ID NO: 1373 - DNA, 40 bp, Artificial Sequence
  Pan degenerate oligonucleotide primer
  primer_bind (1)..(40)
  misc_feature (34)..(40): Adaptor region of the pan degenerate sense primer that adapts the probe-binding site upstream of codon 318 to correspond to the nucleotides in an oligonucleotide probe upstream of the discriminating single nucleotide polymorphism.
araayagrgarattytaararmmccwgtrcatggrgyvta

SEQ ID NO: 1374 - DNA, 43 bp, Artificial Sequence
  Pan degenerate oligonucleotide primer
  primer_bind (1)..(43)
  misc_feature (37)..(43): Adaptor region of the pan degenerate sense primer that adapts the probe-binding site upstream of codon 318 to correspond to the nucleotides in an oligonucleotide probe upstream of the discriminating single nucleotide polymorphism.
ytrgcrgaraayagrgarattytrararmvccwgtrcatggag

SEQ ID NO: 1375 - DNA, 29 bp, Artificial Sequence
  Pan degenerate oligonucleotide primer
  primer_bind (1)..(29)
  misc_feature (22)..(28): Adaptor region of the pan degenerate sense primer that adapts the probe-binding site upstream of codon 318 to correspond to the nucleotides in an oligonucleotide probe upstream of the discriminating single nucleotide polymorphism.
  modified_base (29)..(29): base is a locked nucleic acid
  misc_feature (29)..(29): n is a, c, g, or t
ttytaararmmccwgtrcatggrgyvtan

SEQ ID NO: 1376 - DNA, 39 bp, Artificial Sequence
  Pan degenerate oligonucleotide primer
  primer_bind (1)..(39)
  misc_feature (32)..(38): Adaptor region of the pan degenerate sense primer that adapts the probe-binding site upstream of codon 318 to correspond to the nucleotides in an oligonucleotide probe upstream of the discriminating single nucleotide polymorphism.
  modified_base (39)..(39): base is a locked nucleic acid
  misc_feature (39)..(39): n is a, c, g, or t
aayagrgarattytaararmmccwgtrcatggrgyvtan

SEQ ID NO: 1377 - DNA, 41 bp, Artificial Sequence
  Pan degenerate oligonucleotide primer
  primer_bind (1)..(41)
  misc_feature (34)..(40): Adaptor region of the pan degenerate sense primer that adapts the probe-binding site upstream of codon 318 to correspond to the nucleotides in an oligonucleotide probe upstream of the discriminating single nucleotide polymorphism.
  modified_base (41)..(41): base is a locked nucleic acid
  misc_feature (41)..(41): n is a, c, g, or t
araayagrgarattytaararmmccwgtrcatggrgyvtan

SEQ ID NO: 1378 - DNA, 44 bp, Artificial Sequence
  Pan degenerate oligonucleotide primer
  primer_bind (1)..(44)
  misc_feature (37)..(43): Adaptor region of the pan degenerate sense primer that adapts the probe-binding site upstream of codon 318 to correspond to the nucleotides in an oligonucleotide probe upstream of the discriminating single nucleotide polymorphism.
  modified_base (44)..(44): base is a locked nucleic acid
  misc_feature (44)..(44): n is a, c, g, or t
ytrgcrgaraayagrgarattytrararmvccwgtrcatggagn

SEQ ID NO: 1379 - DNA, 28 bp, Artificial Sequence
  Pan degenerate oligonucleotide primer
  primer_bind (1)..(28)
  modified_base (1)..(1): base is a locked nucleic acid
  misc_feature (22)..(28): Adaptor region of the pan degenerate sense primer that adapts the probe-binding site upstream of codon 318 to correspond to the nucleotides in an oligonucleotide probe upstream of the discriminating single nucleotide polymorphism.
  modified_base (27)..(27): base is a locked nucleic acid
ttytaararmmccwgtrcatggrgyvta

SEQ ID NO: 1380 - DNA, 28 bp, Artificial Sequence
  Pan degenerate oligonucleotide primer
  primer_bind (1)..(28)
  modified_base (1)..(1): base is a locked nucleic acid
  misc_feature (22)..(28): Adaptor region of the pan degenerate sense primer that adapts the probe-binding site upstream of codon 318 to correspond to the nucleotides in an oligonucleotide probe upstream of the discriminating single nucleotide polymorphism.
ttytaararmmccwgtrcatggrgyvta

SEQ ID NO: 1381 - DNA, 38 bp, Artificial Sequence; identical to SEQ ID NO: 1372
  Pan degenerate oligonucleotide primer
  primer_bind (1)..(38)
  modified_base (1)..(1): base is a locked nucleic acid
  modified_base (11)..(11): base is a locked nucleic acid
  misc_feature (32)..(38): Adaptor region of the pan degenerate sense primer that adapts the probe-binding site upstream of codon 318 to correspond to the nucleotides in an oligonucleotide probe upstream of the discriminating single nucleotide polymorphism.

SEQ ID NO: 1382 - DNA, 38 bp, Artificial Sequence; identical to SEQ ID NO: 1372
  Pan degenerate oligonucleotide primer
  primer_bind (1)..(38)
  modified_base (1)..(1): base is a locked nucleic acid
  misc_feature (32)..(38): Adaptor region of the pan degenerate sense primer that adapts the probe-binding site upstream of codon 318 to correspond to the nucleotides in an oligonucleotide probe upstream of the discriminating single nucleotide polymorphism.
  modified_base (37)..(37): base is a locked nucleic acid

SEQ ID NO: 1383 - DNA, 38 bp, Artificial Sequence; identical to SEQ ID NO: 1372
  Pan degenerate oligonucleotide primer
  primer_bind (1)..(38)
  modified_base (1)..(1): base is a locked nucleic acid
  modified_base (11)..(11): base is a locked nucleic acid
  misc_feature (32)..(38): Adaptor region of the pan degenerate sense primer that adapts the probe-binding site upstream of codon 318 to correspond to the nucleotides in an oligonucleotide probe upstream of the discriminating single nucleotide polymorphism.
  modified_base (37)..(37): base is a locked nucleic acid

SEQ ID NO: 1384 - DNA, 40 bp, Artificial Sequence; identical to SEQ ID NO: 1373
  Pan degenerate oligonucleotide primer
  primer_bind (1)..(40)
  modified_base (1)..(1): base is a locked nucleic acid
  modified_base (3)..(3): base is a locked nucleic acid
  misc_feature (34)..(40): Adaptor region of the pan degenerate sense primer that adapts the probe-binding site upstream of codon 318 to correspond to the nucleotides in an oligonucleotide probe upstream of the discriminating single nucleotide polymorphism.
  modified_base (39)..(39): base is a locked nucleic acid

SEQ ID NO: 1385 - DNA, 40 bp, Artificial Sequence; identical to SEQ ID NO: 1373
  Pan degenerate oligonucleotide primer
  primer_bind (1)..(40)
  modified_base (1)..(1): base is a locked nucleic acid
  modified_base (13)..(13): base is a locked nucleic acid
  misc_feature (34)..(40): Adaptor region of the pan degenerate sense primer that adapts the probe-binding site upstream of codon 318 to correspond to the nucleotides in an oligonucleotide probe upstream of the discriminating single nucleotide polymorphism.
  modified_base (39)..(39): base is a locked nucleic acid

SEQ ID NO: 1386 - DNA, 40 bp, Artificial Sequence; identical to SEQ ID NO: 1373
  Pan degenerate oligonucleotide primer
  primer_bind (1)..(40)
  modified_base (1)..(1): base is a locked nucleic acid
  modified_base (3)..(3): base is a locked nucleic acid
  modified_base (13)..(13): base is a locked nucleic acid
  misc_feature (34)..(40): Adaptor region of the pan degenerate sense primer that adapts the probe-binding site upstream of codon 318 to correspond to the nucleotides in an oligonucleotide probe upstream of the discriminating single nucleotide polymorphism.

SEQ ID NO: 1387 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 40 to correspond to the nucleotides in an oligonucleotide probe downstream of the discriminating single nucleotide polymorphism.
rttrtatggrttytcaggcccrattyttgwrattttyccttcytyttccat

SEQ ID NO: 1388 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 40 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rttrtatggrttytcaggcccrattyttgwrattttyccttcytyttccatn

SEQ ID NO: 1389 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 41 to correspond to the nucleotides in an oligonucleotide probe downstream of the discriminating single nucleotide polymorphism.
tcaggcccaattyttgwrattttyccttcytyytcca

SEQ ID NO: 1390 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 41 to correspond to the nucleotides in an oligonucleotide probe downstream of the discriminating single nucleotide polymorphism.
ttcaggcccaattyttgwrattttyccttcytyytcca

SEQ ID NO: 1391 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 41 to correspond to the nucleotides in an oligonucleotide probe downstream of the discriminating single nucleotide polymorphism.
ttttcaggcccaattyttgwrattttyccttcytyytcca

SEQ ID NO: 1392 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 41 to correspond to the nucleotides in an oligonucleotide probe downstream of the discriminating single nucleotide polymorphism.
aattyttgwrattttyccttcytyytcca

SEQ ID NO: 1393 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 41 to correspond to the nucleotides in an oligonucleotide probe downstream of the discriminating single nucleotide polymorphism.
ccaattyttgwrattttyccttcytyytcca

SEQ ID NO: 1394 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 41 to correspond to the nucleotides in an oligonucleotide probe downstream of the discriminating single nucleotide polymorphism.
cccaattyttgwrattttyccttcytyytcca

SEQ ID NO: 1395 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 41 to correspond to the nucleotides in an oligonucleotide probe downstream of the discriminating single nucleotide polymorphism.
gtrttrtatggrttytcaggcccrattyttgwrattttyccttcyttttc

SEQ ID NO: 1396 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 41 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
tcaggcccaattyttgwrattttyccttcytyytccan

SEQ ID NO: 1397 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 41 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ttcaggcccaattyttgwrattttyccttcytyytccan

SEQ ID NO: 1398 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 41 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ttttcaggcccaattyttgwrattttyccttcytyytccan

SEQ ID NO: 1399 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 41 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
aattyttgwrattttyccttcytyytccan

SEQ ID NO: 1400 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 41 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
ccaattyttgwrattttyccttcytyytccan

SEQ ID NO: 1401 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 41 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
cccaattyttgwrattttyccttcytyytccan

SEQ ID NO: 1402 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 41 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
gtrttrtatggrttytcaggcccrattyttgwrattttyccttcyttttcn

SEQ ID NO: 1403 - DNA, 37 bp, Artificial Sequence; identical to SEQ ID NO: 1389
  Pan degenerate oligonucleotide primer
  primer_bind (1)..(37)
  modified_base (1)..(1): base is a locked nucleic acid
  modified_base (6)..(6): base is a locked nucleic acid
  modified_base (9)..(9): base is a locked nucleic acid
  misc_feature (31)..(37): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1404 - DNA, 37 bp, Artificial Sequence; identical to SEQ ID NO: 1389
  Pan degenerate oligonucleotide primer
  primer_bind (1)..(37)
  modified_base (1)..(1): base is a locked nucleic acid
  modified_base (7)..(7): base is a locked nucleic acid
  modified_base (9)..(9): base is a locked nucleic acid
  misc_feature (31)..(37): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1405 - DNA, 37 bp, Artificial Sequence; identical to SEQ ID NO: 1389
  Pan degenerate oligonucleotide primer
  primer_bind (1)..(37)
  modified_base (1)..(1): base is a locked nucleic acid
  modified_base (6)..(6): base is a locked nucleic acid
  modified_base (7)..(7): base is a locked nucleic acid
  misc_feature (31)..(37): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1406 - DNA, 38 bp, Artificial Sequence; identical to SEQ ID NO: 1390
  Pan degenerate oligonucleotide primer
  primer_bind (1)..(38)
  modified_base (1)..(1): base is a locked nucleic acid
  modified_base (2)..(2): base is a locked nucleic acid
  modified_base (8)..(8): base is a locked nucleic acid
  misc_feature (32)..(38): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1407 - DNA, 38 bp, Artificial Sequence; identical to SEQ ID NO: 1390
  Pan degenerate oligonucleotide primer
  primer_bind (1)..(38)
  modified_base (1)..(1): base is a locked nucleic acid
  modified_base (7)..(7): base is a locked nucleic acid
  modified_base (8)..(8): base is a locked nucleic acid
  misc_feature (32)..(38): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1408 - DNA, 38 bp, Artificial Sequence; identical to SEQ ID NO: 1390
  Pan degenerate oligonucleotide primer
  primer_bind (1)..(38)
  modified_base (1)..(1): base is a locked nucleic acid
  modified_base (2)..(2): base is a locked nucleic acid
  modified_base (7)..(7): base is a locked nucleic acid
  misc_feature (32)..(38): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1409 - DNA, 40 bp, Artificial Sequence; identical to SEQ ID NO: 1391
  Pan degenerate oligonucleotide primer
  primer_bind (1)..(40)
  modified_base (1)..(1): base is a locked nucleic acid
  modified_base (3)..(3): base is a locked nucleic acid
  modified_base (9)..(9): base is a locked nucleic acid
  misc_feature (34)..(40): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1410 - DNA, 40 bp, Artificial Sequence; identical to SEQ ID NO: 1391
  Pan degenerate oligonucleotide primer
  primer_bind (1)..(40)
  modified_base (1)..(1): base is a locked nucleic acid
  modified_base (4)..(4): base is a locked nucleic acid
  modified_base (9)..(9): base is a locked nucleic acid
  misc_feature (34)..(40): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1411 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 41 to correspond to the nucleotides in an oligonucleotide probe downstream of the discriminating single nucleotide polymorphism.
aattyttgwrattttyccttcytyytcca

SEQ ID NO: 1412 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 41 to correspond to the nucleotides in an oligonucleotide probe downstream of the discriminating single nucleotide polymorphism.
aattyttgwrattttyccttcytyytcca

SEQ ID NO: 1413 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 41 to correspond to the nucleotides in an oligonucleotide probe downstream of the discriminating single nucleotide polymorphism.
aattyttgwrattttyccttcytyytcca

SEQ ID NO: 1414 - DNA, 31 bp, Artificial Sequence; identical to SEQ ID NO: 1393
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (25)..(31): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1415 - DNA, 31 bp, Artificial Sequence; identical to SEQ ID NO: 1393
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1416 - DNA, 31 bp, Artificial Sequence; identical to SEQ ID NO: 1393
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1417 - DNA, 32 bp, Artificial Sequence; identical to SEQ ID NO: 1394
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1418 - DNA, 32 bp, Artificial Sequence; identical to SEQ ID NO: 1394
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1419 - DNA, 32 bp, Artificial Sequence; identical to SEQ ID NO: 1394
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1420 - DNA, 40 bp, Artificial Sequence; identical to SEQ ID NO: 1391
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 41 to correspond to the nucleotides in an oligonucleotide probe downstream of the discriminating single nucleotide polymorphism.

SEQ ID NO: 1421 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 44 to correspond to the nucleotides in an oligonucleotide probe downstream of the discriminating single nucleotide polymorphism.
trtatggrttttcaggcccaattyttgwrattttycc

SEQ ID NO: 1422 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.
tatggrttttcaggcccaattyttgwrattttycct

SEQ ID NO: 1423 - DNA, 39 bp, Artificial Sequence
  Pan degenerate oligonucleotide primer
  primer_bind (1)..(39)
  misc_feature (33)..(39): Adaptor region of the pan degenerate antisense primer that adapts the probe-binding site downstream of codon 44 to correspond to the nucleotides in an oligonucleotide probe downstream of the discriminating single nucleotide polymorphism.
rttrtatggrttttcaggcccaattyttgwrattttycc

SEQ ID NO: 1424 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 44 to correspond to the nucleotides in an oligonucleotide probe downstream of the discriminating single nucleotide polymorphism.
trtatggrttttcaggcccaattyttgwrattttycct

SEQ ID NO: 1425 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.
trttrtatggrttttcaggcccaattyttgwrattttycc

SEQ ID NO: 1426 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.
rttrtatggrttttcaggcccaattyttgwrattttycct

SEQ ID NO: 1427 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 44 to correspond to the nucleotides in an oligonucleotide probe downstream of the discriminating single nucleotide polymorphism.
tttcaggcccaattyttgwrattttycc

SEQ ID NO: 1428 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 44 to correspond to the nucleotides in an oligonucleotide probe downstream of the discriminating single nucleotide polymorphism.
tcaggcccaattyttgwrattttycct

SEQ ID NO: 1429 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 44 to correspond to the nucleotides in an oligonucleotide probe downstream of the discriminating single nucleotide polymorphism.
tggrttttcaggcccaattyttgwrattttycc

SEQ ID NO: 1430 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 44 to correspond to the nucleotides in an oligonucleotide probe downstream of the discriminating single nucleotide polymorphism.
grttttcaggcccaattyttgwrattttycct

SEQ ID NO: 1431 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.
rtatggrttttcaggcccaattyttgwrattttycc

SEQ ID NO: 1432 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 44 to correspond to the nucleotides in an oligonucleotide probe downstream of the discriminating single nucleotide polymorphism.
atggrttttcaggcccaattyttgwrattttycct

SEQ ID NO: 1433 - DNA, 52 bp, Artificial Sequence
  Pan degenerate oligonucleotide primer
  primer_bind (1)..(52)
  misc_feature (46)..(52): Adaptor region of the pan degenerate antisense primer that adapts the probe-binding site downstream of codon 44 to correspond to the nucleotides in an oligonucleotide probe downstream of the discriminating single nucleotide polymorphism.
caaataytggagtrttrtatggrttytcaggcccrattyttgwratttttcc

SEQ ID NO: 1434 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
trtatggrttttcaggcccaattyttgwrattttyccn

SEQ ID NO: 1435 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
tatggrttttcaggcccaattyttgwrattttycctn

SEQ ID NO: 1436 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
rttrtatggrttttcaggcccaattyttgwrattttyccn

SEQ ID NO: 1437 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
trtatggrttttcaggcccaattyttgwrattttycctn

SEQ ID NO: 1438 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
trttrtatggrttttcaggcccaattyttgwrattttyccn

SEQ ID NO: 1439 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
rttrtatggrttttcaggcccaattyttgwrattttycctn

SEQ ID NO: 1440 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tttcaggcccaattyttgwrattttyccn

SEQ ID NO: 1441 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
tcaggcccaattyttgwrattttycctn

SEQ ID NO: 1442 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tggrttttcaggcccaattyttgwrattttyccn

SEQ ID NO: 1443 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
grttttcaggcccaattyttgwrattttycctn

SEQ ID NO: 1444 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
rtatggrttttcaggcccaattyttgwrattttyccn

SEQ ID NO: 1445 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
atggrttttcaggcccaattyttgwrattttycctn

SEQ ID NO: 1446 - DNA, 53 bp, Artificial Sequence
  Pan degenerate oligonucleotide primer
  primer_bind (1)..(53)
  misc_feature (46)..(52): Adaptor region of the pan degenerate antisense primer that adapts the probe-binding site downstream of codon 44 to correspond to the nucleotides in an oligonucleotide probe downstream of the discriminating single nucleotide polymorphism.
  modified_base (53)..(53): base is a locked nucleic acid
  misc_feature (53)..(53): n is a, c, g, or t
caaataytggagtrttrtatggrttytcaggcccrattyttgwratttttccn

SEQ ID NO: 1447 - DNA, 37 bp, Artificial Sequence; identical to SEQ ID NO: 1421
  Pan degenerate oligonucleotide primer
  primer_bind (1)..(37)
  modified_base (1)..(1): base is a locked nucleic acid
  modified_base (2)..(2): base is a locked nucleic acid
  modified_base (10)..(10): base is a locked nucleic acid
  misc_feature (31)..(37): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1448 - DNA, 36 bp, Artificial Sequence; identical to SEQ ID NO: 1422
  Pan degenerate oligonucleotide primer
  primer_bind (1)..(36)
  modified_base (1)..(1): base is a locked nucleic acid
  modified_base (2)..(2): base is a locked nucleic acid
  modified_base (10)..(10): base is a locked nucleic acid
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1449 - DNA, 37 bp, Artificial Sequence; identical to SEQ ID NO: 1421
  Pan degenerate oligonucleotide primer
  primer_bind (1)..(37)
  modified_base (1)..(1): base is a locked nucleic acid
  modified_base (5)..(5): base is a locked nucleic acid
  modified_base (10)..(10): base is a locked nucleic acid
  misc_feature (31)..(37): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1450 - DNA, 36 bp, Artificial Sequence; identical to SEQ ID NO: 1422
  Pan degenerate oligonucleotide primer
  primer_bind (1)..(36)
  modified_base (1)..(1): base is a locked nucleic acid
  modified_base (5)..(5): base is a locked nucleic acid
  modified_base (10)..(10): base is a locked nucleic acid
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1451 - DNA, 37 bp, Artificial Sequence; identical to SEQ ID NO: 1421
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1452 - DNA, 36 bp, Artificial Sequence; identical to SEQ ID NO: 1422
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1453 - DNA, 39 bp, Artificial Sequence; identical to SEQ ID NO: 1423
  Pan degenerate oligonucleotide primer
  primer_bind (1)..(39)
  modified_base (1)..(1): base is a locked nucleic acid
  modified_base (3)..(3): base is a locked nucleic acid
  modified_base (7)..(7): base is a locked nucleic acid
  misc_feature (33)..(39): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1454 - DNA, 38 bp, Artificial Sequence; identical to SEQ ID NO: 1424
  Pan degenerate oligonucleotide primer
  primer_bind (1)..(38)
  modified_base (1)..(1): base is a locked nucleic acid
  modified_base (3)..(3): base is a locked nucleic acid
  modified_base (7)..(7): base is a locked nucleic acid
  misc_feature (32)..(38): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1455 - DNA, 39 bp, Artificial Sequence; identical to SEQ ID NO: 1423
  Pan degenerate oligonucleotide primer
  primer_bind (1)..(39)
  modified_base (1)..(1): base is a locked nucleic acid
  modified_base (4)..(4): base is a locked nucleic acid
  modified_base (7)..(7): base is a locked nucleic acid
  misc_feature (33)..(39): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1456 - DNA, 38 bp, Artificial Sequence; identical to SEQ ID NO: 1424
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1457 - DNA, 39 bp, Artificial Sequence; identical to SEQ ID NO: 1423
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1458 - DNA, 38 bp, Artificial Sequence; identical to SEQ ID NO: 1424
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1459 - DNA, 40 bp, Artificial Sequence; identical to SEQ ID NO: 1425
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1460 - DNA, 40 bp, Artificial Sequence; identical to SEQ ID NO: 1426
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1461 - DNA, 40 bp, Artificial Sequence; identical to SEQ ID NO: 1425
  Pan degenerate oligonucleotide primer
  primer_bind (1)..(40)
  modified_base (1)..(1): base is a locked nucleic acid
  modified_base (4)..(4): base is a locked nucleic acid
  modified_base (5)..(5): base is a locked nucleic acid
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1462 - DNA, 40 bp, Artificial Sequence; identical to SEQ ID NO: 1426
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1463 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (8)..(8): base is a locked nucleic acid
  misc_feature (22)..(28): Adaptor region of the pan degenerate antisense primer that adapts the probe-binding site downstream of codon 44 to correspond to the nucleotides in an oligonucleotide probe downstream of the discriminating single nucleotide polymorphism.
tttcaggcccaattyttgwrattttycc

SEQ ID NO: 1464 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (8)..(8): base is a locked nucleic acid
  misc_feature (21)..(27): Adaptor region of the pan degenerate antisense primer that adapts the probe-binding site downstream of codon 44 to correspond to the nucleotides in an oligonucleotide probe downstream of the discriminating single nucleotide polymorphism.
tcaggcccaattyttgwrattttycct

SEQ ID NO: 1465 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (8)..(8): base is a locked nucleic acid
  misc_feature (22)..(28): Adaptor region of the pan degenerate antisense primer that adapts the probe-binding site downstream of codon 44 to correspond to the nucleotides in an oligonucleotide probe downstream of the discriminating single nucleotide polymorphism.
tttcaggcccaattyttgwrattttycc

SEQ ID NO: 1466 - DNA, 27 bp, Artificial Sequence
  Pan degenerate oligonucleotide primer
  primer_bind (1)..(27)
  modified_base (1)..(1): base is a locked nucleic acid
  modified_base (7)..(7): base is a locked nucleic acid
  modified_base (8)..(8): base is a locked nucleic acid
  misc_feature (21)..(27): Adaptor region of the pan degenerate antisense primer that adapts the probe-binding site downstream of codon 44 to correspond to the nucleotides in an oligonucleotide probe downstream of the discriminating single nucleotide polymorphism.
tcaggcccaattyttgwrattttycct

SEQ ID NO: 1467 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (7)..(7): base is a locked nucleic acid
  misc_feature (22)..(28): Adaptor region of the pan degenerate antisense primer that adapts the probe-binding site downstream of codon 44 to correspond to the nucleotides in an oligonucleotide probe downstream of the discriminating single nucleotide polymorphism.
tttcaggcccaattyttgwrattttycc

SEQ ID NO: 1468 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (7)..(7): base is a locked nucleic acid
  misc_feature (21)..(27): Adaptor region of the pan degenerate antisense primer that adapts the probe-binding site downstream of codon 44 to correspond to the nucleotides in an oligonucleotide probe downstream of the discriminating single nucleotide polymorphism.
tcaggcccaattyttgwrattttycct

SEQ ID NO: 1469 - DNA, 33 bp, Artificial Sequence; identical to SEQ ID NO: 1429
  Pan degenerate oligonucleotide primer
  primer_bind (1)..(33)
  modified_base (1)..(1): base is a locked nucleic acid
  modified_base (6)..(6): base is a locked nucleic acid
  modified_base (12)..(12): base is a locked nucleic acid
  misc_feature (27)..(33): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1470 - DNA, 32 bp, Artificial Sequence; identical to SEQ ID NO: 1430
  Pan degenerate oligonucleotide primer
  primer_bind (1)..(32)
  modified_base (1)..(1): base is a locked nucleic acid
  modified_base (6)..(6): base is a locked nucleic acid
  modified_base (12)..(12): base is a locked nucleic acid
  misc_feature (26)..(32): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1471 - DNA, 33 bp, Artificial Sequence; identical to SEQ ID NO: 1429
  Pan degenerate oligonucleotide primer
  primer_bind (1)..(33)
  modified_base (1)..(1): base is a locked nucleic acid
  modified_base (10)..(10): base is a locked nucleic acid
  modified_base (12)..(12): base is a locked nucleic acid
  misc_feature (27)..(33): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1472 - DNA, 32 bp, Artificial Sequence; identical to SEQ ID NO: 1430
  Pan degenerate oligonucleotide primer
  primer_bind (1)..(32)
  modified_base (1)..(1): base is a locked nucleic acid
  modified_base (10)..(10): base is a locked nucleic acid
  modified_base (12)..(12): base is a locked nucleic acid
  misc_feature (26)..(32): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1473 - DNA, 33 bp, Artificial Sequence; identical to SEQ ID NO: 1429
  Pan degenerate oligonucleotide primer
  primer_bind (1)..(33)
  modified_base (1)..(1): base is a locked nucleic acid
  modified_base (6)..(6): base is a locked nucleic acid
  modified_base (10)..(10): base is a locked nucleic acid
  misc_feature (27)..(33): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1474 - DNA, 32 bp, Artificial Sequence; identical to SEQ ID NO: 1430
  Pan degenerate oligonucleotide primer
  primer_bind (1)..(32)
  modified_base (1)..(1): base is a locked nucleic acid
  modified_base (6)..(6): base is a locked nucleic acid
  modified_base (10)..(10): base is a locked nucleic acid
  misc_feature (26)..(32): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1475 - DNA, 36 bp, Artificial Sequence; identical to SEQ ID NO: 1431
  Pan degenerate oligonucleotide primer
  primer_bind (1)..(36)
  modified_base (1)..(1): base is a locked nucleic acid
  modified_base (4)..(4): base is a locked nucleic acid
  modified_base (13)..(13): base is a locked nucleic acid
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1476 - DNA, 35 bp, Artificial Sequence; identical to SEQ ID NO: 1432
  Pan degenerate oligonucleotide primer
  primer_bind (1)..(35)
  modified_base (1)..(1): base is a locked nucleic acid
  modified_base (4)..(4): base is a locked nucleic acid
  modified_base (13)..(13): base is a locked nucleic acid
  misc_feature (29)..(35): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1477 - DNA, 36 bp, Artificial Sequence; identical to SEQ ID NO: 1431
  Pan degenerate oligonucleotide primer
  primer_bind (1)..(36)
  modified_base (1)..(1): base is a locked nucleic acid
  modified_base (9)..(9): base is a locked nucleic acid
  modified_base (13)..(13): base is a locked nucleic acid
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1478 - DNA, 35 bp, Artificial Sequence; identical to SEQ ID NO: 1432
  Pan degenerate oligonucleotide primer
  primer_bind (1)..(35)
  modified_base (1)..(1): base is a locked nucleic acid
  modified_base (9)..(9): base is a locked nucleic acid
  modified_base (13)..(13): base is a locked nucleic acid
  misc_feature (29)..(35): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1479 - DNA, 36 bp, Artificial Sequence; identical to SEQ ID NO: 1431
  Pan degenerate oligonucleotide primer
  primer_bind (1)..(36)
  modified_base (1)..(1): base is a locked nucleic acid
  modified_base (4)..(4): base is a locked nucleic acid
  modified_base (9)..(9): base is a locked nucleic acid
  misc_feature (30)..(36): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1480 - DNA, 35 bp, Artificial Sequence; identical to SEQ ID NO: 1432
  Pan degenerate oligonucleotide primer
  primer_bind (1)..(35)
  modified_base (1)..(1): base is a locked nucleic acid
  modified_base (4)..(4): base is a locked nucleic acid
  modified_base (9)..(9): base is a locked nucleic acid
  misc_feature (29)..(35): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1481 - DNA, 40 bp, Artificial Sequence; identical to SEQ ID NO: 1425
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1482 - DNA, 40 bp, Artificial Sequence; identical to SEQ ID NO: 1426
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 44 to correspond to the nucleotides in an oligonucleotide probe downstream of the discriminating single nucleotide polymorphism.

SEQ ID NO: 1483 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 62 to correspond to the nucleotides in an oligonucleotide probe downstream of the discriminating single nucleotide polymorphism.
aatttyctccayttrgtrctrtyyttyttytttatr

SEQ ID NO: 1484 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 62 to correspond to the nucleotides in an oligonucleotide probe downstream of the discriminating single nucleotide polymorphism.
ctaatttyctccayttrgtrctrtyyttyttytttatr

SEQ ID NO: 1485 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 62 to correspond to the nucleotides in an oligonucleotide probe downstream of the discriminating single nucleotide polymorphism.
tactaatttyctccayttrgtrctrtyyttyttytttatr

SEQ ID NO: 1486 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 62 to correspond to the nucleotides in an oligonucleotide probe downstream of the discriminating single nucleotide polymorphism.
tccayttrgtrctrtyyttyttytttatr

SEQ ID NO: 1487 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 62 to correspond to the nucleotides in an oligonucleotide probe downstream of the discriminating single nucleotide polymorphism.
ctccayttrgtrctrtyyttyttytttatr

SEQ ID NO: 1488 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 62 to correspond to the nucleotides in an oligonucleotide probe downstream of the discriminating single nucleotide polymorphism.
ttyctccayttrgtrctrtyyttyttytttatr

SEQ ID NO: 1489 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 62 to correspond to the nucleotides in an oligonucleotide probe downstream of the discriminating single nucleotide polymorphism.
ytcyctraartcyactaatttyctccayttrgtrctrtcyttyttctttat

SEQ ID NO: 1490 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 62 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
aatttyctccayttrgtrctrtyyttyttytttatrn

SEQ ID NO: 1491 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 62 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ctaatttyctccayttrgtrctrtyyttyttytttatrn

SEQ ID NO: 1492 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 62 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tactaatttyctccayttrgtrctrtyyttyttytttatrn

SEQ ID NO: 1493 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 62 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
tccayttrgtrctrtyyttyttytttatrn

SEQ ID NO: 1494 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 62 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
ctccayttrgtrctrtyyttyttytttatrn

SEQ ID NO: 1495 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 62 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
ttyctccayttrgtrctrtyyttyttytttatrn

SEQ ID NO: 1496 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 62 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ytcyctraartcyactaatttyctccayttrgtrctrtcyttyttctttatn

SEQ ID NO: 1497 - DNA, 36 bp, Artificial Sequence; identical to SEQ ID NO: 1483
  Pan degenerate oligonucleotide primer
  primer_bind (1)..(36)
  modified_base (1)..(1): base is a locked nucleic acid
  modified_base (4)..(4): base is a locked nucleic acid
  modified_base (8)..(8): base is a locked nucleic acid
  misc_feature (30)..(36): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1498 - DNA, 36 bp, Artificial Sequence; identical to SEQ ID NO: 1483
  Pan degenerate oligonucleotide primer
  primer_bind (1)..(36)
  modified_base (1)..(1): base is a locked nucleic acid
  modified_base (7)..(7): base is a locked nucleic acid
  modified_base (8)..(8): base is a locked nucleic acid
  misc_feature (30)..(36): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1499 - DNA, 36 bp, Artificial Sequence; identical to SEQ ID NO: 1483
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1500 - DNA, 38 bp, Artificial Sequence; identical to SEQ ID NO: 1484
  Pan degenerate oligonucleotide primer
  primer_bind (1)..(38)
  modified_base (1)..(1): base is a locked nucleic acid
  modified_base (3)..(3): base is a locked nucleic acid
  modified_base (9)..(9): base is a locked nucleic acid
  misc_feature (32)..(38): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1501 - DNA, 38 bp, Artificial Sequence; identical to SEQ ID NO: 1484
  Pan degenerate oligonucleotide primer
  primer_bind (1)..(38)
  modified_base (1)..(1): base is a locked nucleic acid
  modified_base (6)..(6): base is a locked nucleic acid
  modified_base (9)..(9): base is a locked nucleic acid
  misc_feature (32)..(38): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1502 - DNA, 38 bp, Artificial Sequence; identical to SEQ ID NO: 1484
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1503 - DNA, 40 bp, Artificial Sequence; identical to SEQ ID NO: 1485
  Pan degenerate oligonucleotide primer
  primer_bind (1)..(40)
  modified_base (2)..(2): base is a locked nucleic acid
  modified_base (3)..(3): base is a locked nucleic acid
  modified_base (8)..(8): base is a locked nucleic acid
  misc_feature (34)..(40): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1504 - DNA, 40 bp, Artificial Sequence; identical to SEQ ID NO: 1485
  Pan degenerate oligonucleotide primer
  primer_bind (1)..(40)
  modified_base (2)..(2): base is a locked nucleic acid
  modified_base (5)..(5): base is a locked nucleic acid
  modified_base (8)..(8): base is a locked nucleic acid
  misc_feature (34)..(40): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1505 - DNA, 29 bp, Artificial Sequence
  Pan degenerate oligonucleotide primer
  primer_bind (1)..(29)
  modified_base (1)..(1): base is a locked nucleic acid
  modified_base (12)..(12): base is a locked nucleic acid
  modified_base (16)..(16): base is a locked nucleic acid
  misc_feature (23)..(29): Adaptor region of the pan degenerate antisense primer that adapts the probe-binding site downstream of codon 62 to correspond to the nucleotides in an oligonucleotide probe downstream of the discriminating single nucleotide polymorphism.
tccayttrgtrctrtyyttyttytttatr

SEQ ID NO: 1506 - DNA, 29 bp, Artificial Sequence
  Pan degenerate oligonucleotide primer
  primer_bind (1)..(29)
  modified_base (1)..(1): base is a locked nucleic acid
  modified_base (15)..(15): base is a locked nucleic acid
  modified_base (16)..(16): base is a locked nucleic acid
  misc_feature (23)..(29): Adaptor region of the pan degenerate antisense primer that adapts the probe-binding site downstream of codon 62 to correspond to the nucleotides in an oligonucleotide probe downstream of the discriminating single nucleotide polymorphism.
tccayttrgtrctrtyyttyttytttatr

SEQ ID NO: 1507 - DNA, 29 bp, Artificial Sequence
  Pan degenerate oligonucleotide primer
  primer_bind (1)..(29)
  modified_base (1)..(1): base is a locked nucleic acid
  modified_base (12)..(12): base is a locked nucleic acid
  modified_base (15)..(15): base is a locked nucleic acid
  misc_feature (23)..(29): Adaptor region of the pan degenerate antisense primer that adapts the probe-binding site downstream of codon 62 to correspond to the nucleotides in an oligonucleotide probe downstream of the discriminating single nucleotide polymorphism.
tccayttrgtrctrtyyttyttytttatr

SEQ ID NO: 1508 - DNA, 30 bp, Artificial Sequence; identical to SEQ ID NO: 1487
  Pan degenerate oligonucleotide primer
  primer_bind (1)..(30)
  modified_base (1)..(1): base is a locked nucleic acid
  modified_base (2)..(2): base is a locked nucleic acid
  modified_base (16)..(16): base is a locked nucleic acid
  misc_feature (24)..(30): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1509 - DNA, 30 bp, Artificial Sequence; identical to SEQ ID NO: 1487
  Pan degenerate oligonucleotide primer
  primer_bind (1)..(30)
  modified_base (1)..(1): base is a locked nucleic acid
  modified_base (13)..(13): base is a locked nucleic acid
  modified_base (16)..(16): base is a locked nucleic acid
  misc_feature (24)..(30): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1510 - DNA, 30 bp, Artificial Sequence; identical to SEQ ID NO: 1487
  Pan degenerate oligonucleotide primer
  primer_bind (1)..(30)
  modified_base (1)..(1): base is a locked nucleic acid
  modified_base (2)..(2): base is a locked nucleic acid
  modified_base (13)..(13): base is a locked nucleic acid
  misc_feature (24)..(30): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1511 - DNA, 33 bp, Artificial Sequence; identical to SEQ ID NO: 1488
  Pan degenerate oligonucleotide primer
  primer_bind (1)..(33)
  modified_base (1)..(1): base is a locked nucleic acid
  modified_base (4)..(4): base is a locked nucleic acid
  modified_base (16)..(16): base is a locked nucleic acid
  misc_feature (27)..(33): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1512 - DNA, 33 bp, Artificial Sequence; identical to SEQ ID NO: 1488
  Pan degenerate oligonucleotide primer
  primer_bind (1)..(33)
  modified_base (1)..(1): base is a locked nucleic acid
  modified_base (5)..(5): base is a locked nucleic acid
  modified_base (16)..(16): base is a locked nucleic acid
  misc_feature (27)..(33): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1513 - DNA, 33 bp, Artificial Sequence; identical to SEQ ID NO: 1488
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1514 - DNA, 40 bp, Artificial Sequence; identical to SEQ ID NO: 1485
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 62 to correspond to the nucleotides in an oligonucleotide probe downstream of the discriminating single nucleotide polymorphism.

SEQ ID NO: 1515 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 65 to correspond to the nucleotides in an oligonucleotide probe downstream of the discriminating single nucleotide polymorphism.
aatttyctccayttrgtrctrtyytty

SEQ ID NO: 1516 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 65 to correspond to the nucleotides in an oligonucleotide probe downstream of the discriminating single nucleotide polymorphism.
ctaatttyctccayttrgtrctrtyytt

SEQ ID NO: 1517 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 65 to correspond to the nucleotides in an oligonucleotide probe downstream of the discriminating single nucleotide polymorphism.
traartctactaatttyctccayttrgtrctrtyytty

SEQ ID NO: 1518 - DNA, 39 bp, Artificial Sequence
  Pan degenerate oligonucleotide primer
  primer_bind (1)..(39)
  misc_feature (33)..(39): Adaptor region of the pan degenerate antisense primer that adapts the probe-binding site downstream of codon 65 to correspond to the nucleotides in an oligonucleotide probe downstream of the discriminating single nucleotide polymorphism.
yctraartctactaatttyctccayttrgtrctrtyytt

SEQ ID NO: 1519 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.
yctraartctactaatttyctccayttrgtrctrtyytty

SEQ ID NO: 1520 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.
cyctraartctactaatttyctccayttrgtrctrtyytt

SEQ ID NO: 1521 - DNA, 22 bp, Artificial Sequence
  Pan degenerate oligonucleotide primer
  primer_bind (1)..(22)
  misc_feature (16)..(22): Adaptor region of the pan degenerate antisense primer that adapts the probe-binding site downstream of codon 65 to correspond to the nucleotides in an oligonucleotide probe downstream of the discriminating single nucleotide polymorphism.
yctccayttrgtrctrtyytty

SEQ ID NO: 1522 - DNA, 23 bp, Artificial Sequence
  Pan degenerate oligonucleotide primer
  primer_bind (1)..(23)
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytt

SEQ ID NO: 1523 - DNA, 23 bp, Artificial Sequence
  Pan degenerate oligonucleotide primer
  primer_bind (1)..(23)
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
tyctccayttrgtrctrtyytty

SEQ ID NO: 1524 - DNA, 24 bp, Artificial Sequence
  Pan degenerate oligonucleotide primer
  primer_bind (1)..(24)
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
tttyctccayttrgtrctrtyytt

SEQ ID NO: 1525 - DNA, 24 bp, Artificial Sequence
  Pan degenerate oligonucleotide primer
  primer_bind (1)..(24)
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytty

SEQ ID NO: 1526 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 65 to correspond to the nucleotides in an oligonucleotide probe downstream of the discriminating single nucleotide polymorphism.
atttyctccayttrgtrctrtyytt

SEQ ID NO: 1527 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 65 to correspond to the nucleotides in an oligonucleotide probe downstream of the discriminating single nucleotide polymorphism.
yttattragytcyctraartcyactaatttyctccayttrgtrctgtcttt

SEQ ID NO: 1528 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
aatttyctccayttrgtrctrtyyttyn

SEQ ID NO: 1529 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
ctaatttyctccayttrgtrctrtyyttn

SEQ ID NO: 1530 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
traartctactaatttyctccayttrgtrctrtyyttyn

SEQ ID NO: 1531 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
yctraartctactaatttyctccayttrgtrctrtyyttn

SEQ ID NO: 1532 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yctraartctactaatttyctccayttrgtrctrtyyttyn

SEQ ID NO: 1533 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
cyctraartctactaatttyctccayttrgtrctrtyyttn

SEQ ID NO: 1534 - DNA, 23 bp, Artificial Sequence
  Pan degenerate oligonucleotide primer
  primer_bind (1)..(23)
  misc_feature (16)..(22): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (23)..(23): base is a locked nucleic acid
  misc_feature (23)..(23): n is a, c, g, or t
yctccayttrgtrctrtyyttyn

SEQ ID NO: 1535 - DNA, 24 bp, Artificial Sequence
  Pan degenerate oligonucleotide primer
  primer_bind (1)..(24)
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (24)..(24): base is a locked nucleic acid
  misc_feature (24)..(24): n is a, c, g, or t
ttyctccayttrgtrctrtyyttn

SEQ ID NO: 1536 - DNA, 24 bp, Artificial Sequence
  Pan degenerate oligonucleotide primer
  primer_bind (1)..(24)
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (24)..(24): base is a locked nucleic acid
  misc_feature (24)..(24): n is a, c, g, or t
tyctccayttrgtrctrtyyttyn

SEQ ID NO: 1537 - DNA, 25 bp, Artificial Sequence
  Pan degenerate oligonucleotide primer
  primer_bind (1)..(25)
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (25)..(25): base is a locked nucleic acid
  misc_feature (25)..(25): n is a, c, g, or t
tttyctccayttrgtrctrtyyttn

SEQ ID NO: 1538 - DNA, 25 bp, Artificial Sequence
  Pan degenerate oligonucleotide primer
  primer_bind (1)..(25)
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (25)..(25): base is a locked nucleic acid
  misc_feature (25)..(25): n is a, c, g, or t
ttyctccayttrgtrctrtyyttyn

SEQ ID NO: 1539 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
atttyctccayttrgtrctrtyyttn

SEQ ID NO: 1540 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 65 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
yttattragytcyctraartcyactaatttyctccayttrgtrctgtctttn

SEQ ID NO: 1541 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (6)..(6): base is a locked nucleic acid
  misc_feature (21)..(27): Adaptor region of the pan degenerate antisense primer that adapts the probe-binding site downstream of codon 65 to correspond to the nucleotides in an oligonucleotide probe downstream of the discriminating single nucleotide polymorphism.
aatttyctccayttrgtrctrtyytty

SEQ ID NO: 1542 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 65 to correspond to the nucleotides in an oligonucleotide probe downstream of the discriminating single nucleotide polymorphism.
ctaatttyctccayttrgtrctrtyytt

SEQ ID NO: 1543 - DNA, 27 bp, Artificial Sequence
  Pan degenerate oligonucleotide primer
  primer_bind (1)..(27)
  modified_base (1)..(1): base is a locked nucleic acid
  modified_base (5)..(5): base is a locked nucleic acid
  modified_base (6)..(6): base is a locked nucleic acid
  misc_feature (21)..(27): Adaptor region of the pan degenerate antisense primer that adapts the probe-binding site downstream of codon 65 to correspond to the nucleotides in an oligonucleotide probe downstream of the discriminating single nucleotide polymorphism.
aatttyctccayttrgtrctrtyytty

SEQ ID NO: 1544 - DNA, 28 bp, Artificial Sequence
  Pan degenerate oligonucleotide primer
  primer_bind (1)..(28)
  modified_base (1)..(1): base is a locked nucleic acid
  modified_base (5)..(5): base is a locked nucleic acid
  modified_base (6)..(6): base is a locked nucleic acid
  misc_feature (22)..(28): Adaptor region of the pan degenerate antisense primer that adapts the probe-binding site downstream of codon 65 to correspond to the nucleotides in an oligonucleotide probe downstream of the discriminating single nucleotide polymorphism.
ctaatttyctccayttrgtrctrtyytt

SEQ ID NO: 1545 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate antisense primer that adapts the probe-binding site downstream of codon 65 to correspond to the nucleotides in an oligonucleotide probe downstream of the discriminating single nucleotide polymorphism.
aatttyctccayttrgtrctrtyytty

SEQ ID NO: 1546 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (5)..(5): base is a locked nucleic acid
  misc_feature (22)..(28): Adaptor region of the pan degenerate antisense primer that adapts the probe-binding site downstream of codon 65 to correspond to the nucleotides in an oligonucleotide probe downstream of the discriminating single nucleotide polymorphism.
ctaatttyctccayttrgtrctrtyytt

SEQ ID NO: 1547 - DNA, 38 bp, Artificial Sequence; identical to SEQ ID NO: 1517
  Pan degenerate oligonucleotide primer
  primer_bind (1)..(38)
  modified_base (1)..(1): base is a locked nucleic acid
  modified_base (12)..(12): base is a locked nucleic acid
  modified_base (16)..(16): base is a locked nucleic acid
  misc_feature (32)..(38): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1548 - DNA, 39 bp, Artificial Sequence; identical to SEQ ID NO: 1518
  Pan degenerate oligonucleotide primer
  primer_bind (1)..(39)
  modified_base (1)..(1): base is a locked nucleic acid
  modified_base (12)..(12): base is a locked nucleic acid
  modified_base (16)..(16): base is a locked nucleic acid
  misc_feature (33)..(39): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1549 - DNA, 38 bp, Artificial Sequence; identical to SEQ ID NO: 1517
  Pan degenerate oligonucleotide primer
  primer_bind (1)..(38)
  modified_base (1)..(1): base is a locked nucleic acid
  modified_base (15)..(15): base is a locked nucleic acid
  modified_base (16)..(16): base is a locked nucleic acid
  misc_feature (32)..(38): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1550 - DNA, 39 bp, Artificial Sequence; identical to SEQ ID NO: 1518
  Pan degenerate oligonucleotide primer
  primer_bind (1)..(39)
  modified_base (1)..(1): base is a locked nucleic acid
  modified_base (15)..(15): base is a locked nucleic acid
  modified_base (16)..(16): base is a locked nucleic acid
  misc_feature (33)..(39): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1551 - DNA, 38 bp, Artificial Sequence; identical to SEQ ID NO: 1517
  Pan degenerate oligonucleotide primer
  primer_bind (1)..(38)
  modified_base (1)..(1): base is a locked nucleic acid
  modified_base (12)..(12): base is a locked nucleic acid
  modified_base (15)..(15): base is a locked nucleic acid
  misc_feature (32)..(38): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1552 - DNA, 39 bp, Artificial Sequence; identical to SEQ ID NO: 1518
  Pan degenerate oligonucleotide primer
  primer_bind (1)..(39)
  modified_base (1)..(1): base is a locked nucleic acid
  modified_base (12)..(12): base is a locked nucleic acid
  modified_base (15)..(15): base is a locked nucleic acid
  misc_feature (33)..(39): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1553 - DNA, 40 bp, Artificial Sequence; identical to SEQ ID NO: 1519
  Pan degenerate oligonucleotide primer
  primer_bind (1)..(40)
  modified_base (2)..(2): base is a locked nucleic acid
  modified_base (3)..(3): base is a locked nucleic acid
  modified_base (17)..(17): base is a locked nucleic acid
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1554 - DNA, 40 bp, Artificial Sequence; identical to SEQ ID NO: 1520
  Pan degenerate oligonucleotide primer
  primer_bind (1)..(40)
  modified_base (1)..(1): base is a locked nucleic acid
  modified_base (2)..(2): base is a locked nucleic acid
  modified_base (16)..(16): base is a locked nucleic acid
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1555 - DNA, 40 bp, Artificial Sequence; identical to SEQ ID NO: 1519
  Pan degenerate oligonucleotide primer
  primer_bind (1)..(40)
  modified_base (2)..(2): base is a locked nucleic acid
  modified_base (14)..(14): base is a locked nucleic acid
  modified_base (17)..(17): base is a locked nucleic acid
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1556 - DNA, 40 bp, Artificial Sequence; identical to SEQ ID NO: 1520
  Pan degenerate oligonucleotide primer
  primer_bind (1)..(40)
  modified_base (1)..(1): base is a locked nucleic acid
  modified_base (13)..(13): base is a locked nucleic acid
  modified_base (16)..(16): base is a locked nucleic acid
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1557 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (5)..(5): base is a locked nucleic acid
  misc_feature (16)..(22): Adaptor region of the pan degenerate antisense primer that adapts the probe-binding site downstream of codon 65 to correspond to the nucleotides in an oligonucleotide probe downstream of the discriminating single nucleotide polymorphism.
yctccayttrgtrctrtyytty

SEQ ID NO: 1558 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (5)..(5): base is a locked nucleic acid
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytt

SEQ ID NO: 1559 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (5)..(5): base is a locked nucleic acid
  misc_feature (16)..(22): Adaptor region of the pan degenerate antisense primer that adapts the probe-binding site downstream of codon 65 to correspond to the nucleotides in an oligonucleotide probe downstream of the discriminating single nucleotide polymorphism.
yctccayttrgtrctrtyytty

SEQ ID NO: 1560 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (5)..(5): base is a locked nucleic acid
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytt

SEQ ID NO: 1561 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (3)..(3): base is a locked nucleic acid
  misc_feature (16)..(22): Adaptor region of the pan degenerate antisense primer that adapts the probe-binding site downstream of codon 65 to correspond to the nucleotides in an oligonucleotide probe downstream of the discriminating single nucleotide polymorphism.
yctccayttrgtrctrtyytty

SEQ ID NO: 1562 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (3)..(3): base is a locked nucleic acid
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytt

SEQ ID NO: 1563 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (4)..(4): base is a locked nucleic acid
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
tyctccayttrgtrctrtyytty

SEQ ID NO: 1564 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
tttyctccayttrgtrctrtyytt

SEQ ID NO: 1565 - DNA, 23 bp, Artificial Sequence
  Pan degenerate oligonucleotide primer
  primer_bind (1)..(23)
  modified_base (1)..(1): base is a locked nucleic acid
  modified_base (3)..(3): base is a locked nucleic acid
  modified_base (4)..(4): base is a locked nucleic acid
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
tyctccayttrgtrctrtyytty

SEQ ID NO: 1566 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (4)..(4): base is a locked nucleic acid
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
tttyctccayttrgtrctrtyytt

SEQ ID NO: 1567 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (3)..(3): base is a locked nucleic acid
  misc_feature (17)..(23): Adaptor region of the pan degenerate antisense primer that adapts the probe-binding site downstream of codon 65 to correspond to the nucleotides in an oligonucleotide probe downstream of the discriminating single nucleotide polymorphism.
tyctccayttrgtrctrtyytty

SEQ ID NO: 1568 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (3)..(3): base is a locked nucleic acid
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
tttyctccayttrgtrctrtyytt

SEQ ID NO: 1569 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (4)..(4): base is a locked nucleic acid
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytty

SEQ ID NO: 1570 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (4)..(4): base is a locked nucleic acid
  misc_feature (19)..(25): Adaptor region of the pan degenerate antisense primer that adapts the probe-binding site downstream of codon 65 to correspond to the nucleotides in an oligonucleotide probe downstream of the discriminating single nucleotide polymorphism.
atttyctccayttrgtrctrtyytt

SEQ ID NO: 1571 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (4)..(4): base is a locked nucleic acid
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytty

SEQ ID NO: 1572 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (4)..(4): base is a locked nucleic acid
  misc_feature (19)..(25): Adaptor region of the pan degenerate antisense primer that adapts the probe-binding site downstream of codon 65 to correspond to the nucleotides in an oligonucleotide probe downstream of the discriminating single nucleotide polymorphism.
atttyctccayttrgtrctrtyytt

SEQ ID NO: 1573 - DNA, 24 bp, Artificial Sequence
  Pan degenerate oligonucleotide primer
  primer_bind (1)..(24)
  modified_base (1)..(1): base is a locked nucleic acid
  modified_base (2)..(2): base is a locked nucleic acid
  modified_base (3)..(3): base is a locked nucleic acid
  misc_feature (18)..(24): Adaptor region of the pan degenerate antisense primer that adapts the probe-binding site downstream of codon 65 to correspond to the nucleotides in an oligonucleotide probe downstream of the discriminating single nucleotide polymorphism.
ttyctccayttrgtrctrtyytty

SEQ ID NO: 1574 - DNA, 25 bp, Artificial Sequence
  Pan degenerate oligonucleotide primer
  primer_bind (1)..(25)
  modified_base (1)..(1): base is a locked nucleic acid
  modified_base (2)..(2): base is a locked nucleic acid
  modified_base (3)..(3): base is a locked nucleic acid
  misc_feature (19)..(25): Adaptor region of the pan degenerate antisense primer that adapts the probe-binding site downstream of codon 65 to correspond to the nucleotides in an oligonucleotide probe downstream of the discriminating single nucleotide polymorphism.
atttyctccayttrgtrctrtyytt

SEQ ID NO: 1575 - DNA, 40 bp, Artificial Sequence; identical to SEQ ID NO: 1519
  Pan degenerate oligonucleotide primer
  primer_bind (1)..(40)
  modified_base (2)..(2): base is a locked nucleic acid
  modified_base (3)..(3): base is a locked nucleic acid
  modified_base (14)..(14): base is a locked nucleic acid
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1576 - DNA, 40 bp, Artificial Sequence; identical to SEQ ID NO: 1520
  Pan degenerate oligonucleotide primer
  primer_bind (1)..(40)
  modified_base (1)..(1): base is a locked nucleic acid
  modified_base (2)..(2): base is a locked nucleic acid
  modified_base (13)..(13): base is a locked nucleic acid
  misc_feature (34)..(40): Adaptor region of the pan degenerate antisense primer that adapts the probe-binding site downstream of codon 65 to correspond to the nucleotides in an oligonucleotide probe downstream of the discriminating single nucleotide polymorphism.

SEQ ID NO: 1577 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctrt

SEQ ID NO: 1578 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrctr

SEQ ID NO: 1579 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.
raartctactaatttyctccayttrgtrct

SEQ ID NO: 1580 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctrt

SEQ ID NO: 1581 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.
aartctactaatttyctccayttrgtrctr

SEQ ID NO: 1582 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 67 to correspond to the nucleotides in an oligonucleotide probe downstream of the discriminating single nucleotide polymorphism.
traartctactaatttyctccayttrgtrct

SEQ ID NO: 1583 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.
agytcyctraartctactaatttyctccayttrgtrctrt

SEQ ID NO: 1584 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.
ragytcyctraartctactaatttyctccayttrgtrctr

SEQ ID NO: 1585 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.
tragytcyctraartctactaatttyctccayttrgtrct

SEQ ID NO: 1586 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 67 to correspond to the nucleotides in an oligonucleotide probe downstream of the discriminating single nucleotide polymorphism.
actaatttyctccayttrgtrctrt

SEQ ID NO: 1587 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctr

SEQ ID NO: 1588 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrct

SEQ ID NO: 1589 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
tactaatttyctccayttrgtrctrt

SEQ ID NO: 1590 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctr

SEQ ID NO: 1591 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrct

SEQ ID NO: 1592 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctrt

SEQ ID NO: 1593 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctr

SEQ ID NO: 1594 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
aartctactaatttyctccayttrgtrct

SEQ ID NO: 1595 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 67 to correspond to the nucleotides in an oligonucleotide probe downstream of the discriminating single nucleotide polymorphism.
gttytyttattragytcyctraartcyactaatttyctccayttrgtact

SEQ ID NO: 1596 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tctactaatttyctccayttrgtrctrtn

SEQ ID NO: 1597 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
artctactaatttyctccayttrgtrctrn

SEQ ID NO: 1598 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
raartctactaatttyctccayttrgtrctn

SEQ ID NO: 1599 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
rtctactaatttyctccayttrgtrctrtn

SEQ ID NO: 1600 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
aartctactaatttyctccayttrgtrctrn

SEQ ID NO: 1601 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
traartctactaatttyctccayttrgtrctn

SEQ ID NO: 1602 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
agytcyctraartctactaatttyctccayttrgtrctrtn

SEQ ID NO: 1603 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ragytcyctraartctactaatttyctccayttrgtrctrn

SEQ ID NO: 1604 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tragytcyctraartctactaatttyctccayttrgtrctn

SEQ ID NO: 1605 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
actaatttyctccayttrgtrctrtn

SEQ ID NO: 1606 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
ctactaatttyctccayttrgtrctrn

SEQ ID NO: 1607 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
rtctactaatttyctccayttrgtrctn

SEQ ID NO: 1608 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
tactaatttyctccayttrgtrctrtn

SEQ ID NO: 1609 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
tctactaatttyctccayttrgtrctrn

SEQ ID NO: 1610 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
artctactaatttyctccayttrgtrctn

SEQ ID NO: 1611 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
ctactaatttyctccayttrgtrctrtn

SEQ ID NO: 1612 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
rtctactaatttyctccayttrgtrctrn

SEQ ID NO: 1613 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
aartctactaatttyctccayttrgtrctn

SEQ ID NO: 1614 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 67 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
gttytyttattragytcyctraartcyactaatttyctccayttrgtactn

SEQ ID NO: 1615 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (4)..(4): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctrt

SEQ ID NO: 1616 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrctr

SEQ ID NO: 1617 - DNA, 30 bp, Artificial Sequence; identical to SEQ ID NO: 1579
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1618 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctrt

SEQ ID NO: 1619 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrctr

SEQ ID NO: 1620 - DNA, 30 bp, Artificial Sequence; identical to SEQ ID NO: 1579
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1621 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (3)..(3): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctrt

SEQ ID NO: 1622 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (3)..(3): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrctr

SEQ ID NO: 1623 - DNA, 30 bp, Artificial Sequence; identical to SEQ ID NO: 1579
  Pan degenerate oligonucleotide primer
  primer_bind (1)..(30)
  modified_base (1)..(1): base is a locked nucleic acid
  modified_base (2)..(2): base is a locked nucleic acid
  modified_base (3)..(3): base is a locked nucleic acid
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1624 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctrt

SEQ ID NO: 1625 - DNA, 30 bp, Artificial Sequence; identical to SEQ ID NO: 1581
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1626 - DNA, 31 bp, Artificial Sequence; identical to SEQ ID NO: 1582
  Pan degenerate oligonucleotide primer
  primer_bind (1)..(31)
  modified_base (1)..(1): base is a locked nucleic acid
  modified_base (2)..(2): base is a locked nucleic acid
  modified_base (4)..(4): base is a locked nucleic acid
  misc_feature (25)..(31): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1627 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctrt

SEQ ID NO: 1628 - DNA, 30 bp, Artificial Sequence; identical to SEQ ID NO: 1581
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1629 - DNA, 31 bp, Artificial Sequence; identical to SEQ ID NO: 1582
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1630 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (3)..(3): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctrt

SEQ ID NO: 1631 - DNA, 30 bp, Artificial Sequence; identical to SEQ ID NO: 1581
  Pan degenerate oligonucleotide primer
  primer_bind (1)..(30)
  modified_base (1)..(1): base is a locked nucleic acid
  modified_base (2)..(2): base is a locked nucleic acid
  modified_base (3)..(3): base is a locked nucleic acid
  misc_feature (24)..(30): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1632 - DNA, 31 bp, Artificial Sequence; identical to SEQ ID NO: 1582
  Pan degenerate oligonucleotide primer
  primer_bind (1)..(31)
  modified_base (1)..(1): base is a locked nucleic acid
  modified_base (2)..(2): base is a locked nucleic acid
  modified_base (3)..(3): base is a locked nucleic acid
  misc_feature (25)..(31): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1633 - DNA, 40 bp, Artificial Sequence; identical to SEQ ID NO: 1583
  Pan degenerate oligonucleotide primer
  primer_bind (1)..(40)
  modified_base (1)..(1): base is a locked nucleic acid
  modified_base (9)..(9): base is a locked nucleic acid
  modified_base (13)..(13): base is a locked nucleic acid
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1634 - DNA, 40 bp, Artificial Sequence; identical to SEQ ID NO: 1584
  Pan degenerate oligonucleotide primer
  primer_bind (1)..(40)
  modified_base (8)..(8): base is a locked nucleic acid
  modified_base (11)..(11): base is a locked nucleic acid
  modified_base (13)..(13): base is a locked nucleic acid
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1635 - DNA, 40 bp, Artificial Sequence; identical to SEQ ID NO: 1585
  Pan degenerate oligonucleotide primer
  primer_bind (1)..(40)
  modified_base (1)..(1): base is a locked nucleic acid
  modified_base (7)..(7): base is a locked nucleic acid
  modified_base (11)..(11): base is a locked nucleic acid
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1636 - DNA, 40 bp, Artificial Sequence; identical to SEQ ID NO: 1584
  Pan degenerate oligonucleotide primer
  primer_bind (1)..(40)
  modified_base (8)..(8): base is a locked nucleic acid
  modified_base (12)..(12): base is a locked nucleic acid
  modified_base (13)..(13): base is a locked nucleic acid
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1637 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (7)..(7): base is a locked nucleic acid
  misc_feature (19)..(25): Adaptor region of the pan degenerate antisense primer that adapts the probe-binding site downstream of codon 67 to correspond to the nucleotides in an oligonucleotide probe downstream of the discriminating single nucleotide polymorphism.
actaatttyctccayttrgtrctrt

SEQ ID NO: 1638 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (7)..(7): base is a locked nucleic acid
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctr

SEQ ID NO: 1639 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (7)..(7): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrct

SEQ ID NO: 1640 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (7)..(7): base is a locked nucleic acid
  misc_feature (19)..(25): Adaptor region of the pan degenerate antisense primer that adapts the probe-binding site downstream of codon 67 to correspond to the nucleotides in an oligonucleotide probe downstream of the discriminating single nucleotide polymorphism.
actaatttyctccayttrgtrctrt

SEQ ID NO: 1641 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (7)..(7): base is a locked nucleic acid
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctr

SEQ ID NO: 1642 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (7)..(7): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrct

SEQ ID NO: 1643 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (4)..(4): base is a locked nucleic acid
  misc_feature (19)..(25): Adaptor region of the pan degenerate antisense primer that adapts the probe-binding site downstream of codon 67 to correspond to the nucleotides in an oligonucleotide probe downstream of the discriminating single nucleotide polymorphism.
actaatttyctccayttrgtrctrt

SEQ ID NO: 1644 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctr

SEQ ID NO: 1645 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (4)..(4): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrct

SEQ ID NO: 1646 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (5)..(5): base is a locked nucleic acid
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
tactaatttyctccayttrgtrctrt

SEQ ID NO: 1647 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctr

SEQ ID NO: 1648 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (5)..(5): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrct

SEQ ID NO: 1649 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (5)..(5): base is a locked nucleic acid
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
tactaatttyctccayttrgtrctrt

SEQ ID NO: 1650 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctr

SEQ ID NO: 1651 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (5)..(5): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrct

SEQ ID NO: 1652 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (4)..(4): base is a locked nucleic acid
  misc_feature (20)..(26): Adaptor region of the pan degenerate antisense primer that adapts the probe-binding site downstream of codon 67 to correspond to the nucleotides in an oligonucleotide probe downstream of the discriminating single nucleotide polymorphism.
tactaatttyctccayttrgtrctrt

SEQ ID NO: 1653 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (4)..(4): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
tctactaatttyctccayttrgtrctr

SEQ ID NO: 1654 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (4)..(4): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
artctactaatttyctccayttrgtrct

SEQ ID NO: 1655 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctrt

SEQ ID NO: 1656 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (5)..(5): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctr

SEQ ID NO: 1657 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
aartctactaatttyctccayttrgtrct

SEQ ID NO: 1658 - DNA, 27 bp, Artificial Sequence
  Pan degenerate oligonucleotide primer
  primer_bind (1)..(27)
  modified_base (1)..(1): base is a locked nucleic acid
  modified_base (3)..(3): base is a locked nucleic acid
  modified_base (5)..(5): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctrt

SEQ ID NO: 1659 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (5)..(5): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctr

SEQ ID NO: 1660 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (5)..(5): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
aartctactaatttyctccayttrgtrct

SEQ ID NO: 1661 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (3)..(3): base is a locked nucleic acid
  misc_feature (21)..(27): Adaptor region of the pan degenerate antisense primer that adapts the probe-binding site downstream of codon 67 to correspond to the nucleotides in an oligonucleotide probe downstream of the discriminating single nucleotide polymorphism.
ctactaatttyctccayttrgtrctrt

SEQ ID NO: 1662 - DNA, 28 bp, Artificial Sequence
  Pan degenerate oligonucleotide primer
  primer_bind (1)..(28)
  modified_base (1)..(1): base is a locked nucleic acid
  modified_base (2)..(2): base is a locked nucleic acid
  modified_base (3)..(3): base is a locked nucleic acid
  misc_feature (22)..(28): Adaptor region of the pan degenerate antisense primer that adapts the probe-binding site downstream of codon 67 to correspond to the nucleotides in an oligonucleotide probe downstream of the discriminating single nucleotide polymorphism.
rtctactaatttyctccayttrgtrctr

SEQ ID NO: 1663 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (3)..(3): base is a locked nucleic acid
  misc_feature (23)..(29): Adaptor region of the pan degenerate antisense primer that adapts the probe-binding site downstream of codon 67 to correspond to the nucleotides in an oligonucleotide probe downstream of the discriminating single nucleotide polymorphism.
aartctactaatttyctccayttrgtrct

SEQ ID NO: 1664 - DNA, 40 bp, Artificial Sequence; identical to SEQ ID NO: 1583
  Pan degenerate oligonucleotide primer
  primer_bind (1)..(40)
  modified_base (9)..(9): base is a locked nucleic acid
  modified_base (12)..(12): base is a locked nucleic acid
  modified_base (13)..(13): base is a locked nucleic acid
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1665 - DNA, 40 bp, Artificial Sequence; identical to SEQ ID NO: 1584
  Pan degenerate oligonucleotide primer
  primer_bind (1)..(40)
  modified_base (8)..(8): base is a locked nucleic acid
  modified_base (11)..(11): base is a locked nucleic acid
  modified_base (12)..(12): base is a locked nucleic acid
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1666 - DNA, 40 bp, Artificial Sequence; identical to SEQ ID NO: 1585
  Pan degenerate oligonucleotide primer
  primer_bind (1)..(40)
  modified_base (7)..(7): base is a locked nucleic acid
  modified_base (10)..(10): base is a locked nucleic acid
  modified_base (11)..(11): base is a locked nucleic acid
  misc_feature (34)..(40): Adaptor region of the pan degenerate antisense primer that adapts the probe-binding site downstream of codon 67 to correspond to the nucleotides in an oligonucleotide probe downstream of the discriminating single nucleotide polymorphism.

SEQ ID NO: 1667 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 69 to correspond to the nucleotides in an oligonucleotide probe downstream of the discriminating single nucleotide polymorphism.
rtcytgagttytyttattragytcyctraartcyactaatttyctccattt

SEQ ID NO: 1668 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 69 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rtcytgagttytyttattragytcyctraartcyactaatttyctccatttn

SEQ ID NO: 1669 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.
tattragytcyctraartctactaatttyctccayt

SEQ ID NO: 1670 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.
yttattragytcyctraartctactaatttyctccay

SEQ ID NO: 1671 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.
ttattragytcyctraartctactaatttyctccayt

SEQ ID NO: 1672 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 70 to correspond to the nucleotides in an oligonucleotide probe downstream of the discriminating single nucleotide polymorphism.
tyttattragytcyctraartctactaatttyctccay

SEQ ID NO: 1673 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.
ctyttattragytcyctraartctactaatttyctccayt

SEQ ID NO: 1674 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.
tctyttattragytcyctraartctactaatttyctccay

SEQ ID NO: 1675 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 70 to correspond to the nucleotides in an oligonucleotide probe downstream of the discriminating single nucleotide polymorphism.
ragytcyctraartctactaatttyctccayt

SEQ ID NO: 1676 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 70 to correspond to the nucleotides in an oligonucleotide probe downstream of the discriminating single nucleotide polymorphism.
ttragytcyctraartctactaatttyctccay

SEQ ID NO: 1677 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 70 to correspond to the nucleotides in an oligonucleotide probe downstream of the discriminating single nucleotide polymorphism.
ttragytcyctraartctactaatttyctccayt

SEQ ID NO: 1678 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.
tattragytcyctraartctactaatttyctccay

SEQ ID NO: 1679 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.
attragytcyctraartctactaatttyctccayt

SEQ ID NO: 1680 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.
ttattragytcyctraartctactaatttyctccay

SEQ ID NO: 1681 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 70 to correspond to the nucleotides in an oligonucleotide probe downstream of the discriminating single nucleotide polymorphism.
aartcytgagttytyttattragytcyctraartcyactaatttyctcca

SEQ ID NO: 1682 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
tattragytcyctraartctactaatttyctccaytn

SEQ ID NO: 1683 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
yttattragytcyctraartctactaatttyctccayn

SEQ ID NO: 1684 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ttattragytcyctraartctactaatttyctccaytn

SEQ ID NO: 1685 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
tyttattragytcyctraartctactaatttyctccayn

SEQ ID NO: 1686 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ctyttattragytcyctraartctactaatttyctccaytn

SEQ ID NO: 1687 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tctyttattragytcyctraartctactaatttyctccayn

SEQ ID NO: 1688 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ragytcyctraartctactaatttyctccaytn

SEQ ID NO: 1689 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
ttragytcyctraartctactaatttyctccayn

SEQ ID NO: 1690 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ttragytcyctraartctactaatttyctccaytn

SEQ ID NO: 1691 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
tattragytcyctraartctactaatttyctccayn

SEQ ID NO: 1692 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
attragytcyctraartctactaatttyctccaytn

SEQ ID NO: 1693 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
ttattragytcyctraartctactaatttyctccayn

SEQ ID NO: 1694 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 70 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
aartcytgagttytyttattragytcyctraartcyactaatttyctccan

SEQ ID NO: 1695 - DNA, 36 bp, Artificial Sequence; identical to SEQ ID NO: 1669
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1696 - DNA, 37 bp, Artificial Sequence; identical to SEQ ID NO: 1670
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1697 - DNA, 36 bp, Artificial Sequence; identical to SEQ ID NO: 1669
  Pan degenerate oligonucleotide primer
  primer_bind (1)..(36)
  modified_base (1)..(1): base is a locked nucleic acid
  modified_base (3)..(3): base is a locked nucleic acid
  modified_base (5)..(5): base is a locked nucleic acid
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1698 - DNA, 37 bp, Artificial Sequence; identical to SEQ ID NO: 1670
  Pan degenerate oligonucleotide primer
  primer_bind (1)..(37)
  modified_base (1)..(1): base is a locked nucleic acid
  modified_base (3)..(3): base is a locked nucleic acid
  modified_base (5)..(5): base is a locked nucleic acid
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1699 - DNA, 36 bp, Artificial Sequence; identical to SEQ ID NO: 1669
  Pan degenerate oligonucleotide primer
  primer_bind (1)..(36)
  modified_base (1)..(1): base is a locked nucleic acid
  modified_base (2)..(2): base is a locked nucleic acid
  modified_base (3)..(3): base is a locked nucleic acid
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1700 - DNA, 37 bp, Artificial Sequence; identical to SEQ ID NO: 1670
  Pan degenerate oligonucleotide primer
  primer_bind (1)..(37)
  modified_base (1)..(1): base is a locked nucleic acid
  modified_base (2)..(2): base is a locked nucleic acid
  modified_base (3)..(3): base is a locked nucleic acid
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1701 - DNA, 37 bp, Artificial Sequence; identical to SEQ ID NO: 1671
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1702 - DNA, 38 bp, Artificial Sequence; identical to SEQ ID NO: 1672
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1703 - DNA, 37 bp, Artificial Sequence; identical to SEQ ID NO: 1671
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1704 - DNA, 38 bp, Artificial Sequence; identical to SEQ ID NO: 1672
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1705 - DNA, 37 bp, Artificial Sequence; identical to SEQ ID NO: 1671
  Pan degenerate oligonucleotide primer
  primer_bind (1)..(37)
  modified_base (1)..(1): base is a locked nucleic acid
  modified_base (2)..(2): base is a locked nucleic acid
  modified_base (3)..(3): base is a locked nucleic acid
  misc_feature (31)..(37): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1706 - DNA, 38 bp, Artificial Sequence; identical to SEQ ID NO: 1672
  Pan degenerate oligonucleotide primer
  primer_bind (1)..(38)
  modified_base (1)..(1): base is a locked nucleic acid
  modified_base (2)..(2): base is a locked nucleic acid
  modified_base (3)..(3): base is a locked nucleic acid
  misc_feature (32)..(38): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1707 - DNA, 40 bp, Artificial Sequence; identical to SEQ ID NO: 1673
  Pan degenerate oligonucleotide primer
  primer_bind (1)..(40)
  modified_base (3)..(3): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1708 - DNA, 40 bp, Artificial Sequence; identical to SEQ ID NO: 1674
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1709 - DNA, 40 bp, Artificial Sequence; identical to SEQ ID NO: 1673
  Pan degenerate oligonucleotide primer
  primer_bind (1)..(40)
  modified_base (3)..(3): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1710 - DNA, 40 bp, Artificial Sequence; identical to SEQ ID NO: 1674
  Pan degenerate oligonucleotide primer
  primer_bind (1)..(40)
  modified_base (2)..(2): base is a locked nucleic acid
  modified_base (4)..(4): base is a locked nucleic acid
  modified_base (5)..(5): base is a locked nucleic acid
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1711 - DNA, 32 bp, Artificial Sequence; identical to SEQ ID NO: 1675
  Pan degenerate oligonucleotide primer
  primer_bind (1)..(32)
  modified_base (1)..(1): base is a locked nucleic acid
  modified_base (2)..(2): base is a locked nucleic acid
  modified_base (10)..(10): base is a locked nucleic acid
  misc_feature (26)..(32): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1712 - DNA, 33 bp, Artificial Sequence; identical to SEQ ID NO: 1676
  Pan degenerate oligonucleotide primer
  primer_bind (1)..(33)
  modified_base (1)..(1): base is a locked nucleic acid
  modified_base (2)..(2): base is a locked nucleic acid
  modified_base (10)..(10): base is a locked nucleic acid
  misc_feature (27)..(33): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1713 - DNA, 32 bp, Artificial Sequence; identical to SEQ ID NO: 1675
  Pan degenerate oligonucleotide primer
  primer_bind (1)..(32)
  modified_base (1)..(1): base is a locked nucleic acid
  modified_base (5)..(5): base is a locked nucleic acid
  modified_base (10)..(10): base is a locked nucleic acid
  misc_feature (26)..(32): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1714 - DNA, 33 bp, Artificial Sequence; identical to SEQ ID NO: 1676
  Pan degenerate oligonucleotide primer
  primer_bind (1)..(33)
  modified_base (1)..(1): base is a locked nucleic acid
  modified_base (5)..(5): base is a locked nucleic acid
  modified_base (10)..(10): base is a locked nucleic acid
  misc_feature (27)..(33): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1715 - DNA, 32 bp, Artificial Sequence; identical to SEQ ID NO: 1675
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1716 - DNA, 33 bp, Artificial Sequence; identical to SEQ ID NO: 1676
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1717 - DNA, 34 bp, Artificial Sequence; identical to SEQ ID NO: 1677
  Pan degenerate oligonucleotide primer
  primer_bind (1)..(34)
  modified_base (1)..(1): base is a locked nucleic acid
  modified_base (3)..(3): base is a locked nucleic acid
  modified_base (7)..(7): base is a locked nucleic acid
  misc_feature (28)..(34): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1718 - DNA, 35 bp, Artificial Sequence; identical to SEQ ID NO: 1678
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1719 - DNA, 34 bp, Artificial Sequence; identical to SEQ ID NO: 1677
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1720 - DNA, 35 bp, Artificial Sequence; identical to SEQ ID NO: 1678
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1721 - DNA, 34 bp, Artificial Sequence; identical to SEQ ID NO: 1677
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1722 - DNA, 35 bp, Artificial Sequence; identical to SEQ ID NO: 1678
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1723 - DNA, 35 bp, Artificial Sequence; identical to SEQ ID NO: 1679
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1724 - DNA, 36 bp, Artificial Sequence; identical to SEQ ID NO: 1680
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1725 - DNA, 35 bp, Artificial Sequence; identical to SEQ ID NO: 1679
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1726 - DNA, 36 bp, Artificial Sequence; identical to SEQ ID NO: 1680
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1727 - DNA, 35 bp, Artificial Sequence; identical to SEQ ID NO: 1679
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1728 - DNA, 36 bp, Artificial Sequence; identical to SEQ ID NO: 1680
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1729 - DNA, 40 bp, Artificial Sequence; identical to SEQ ID NO: 1673
  Pan degenerate oligonucleotide primer
  primer_bind (1)..(40)
  modified_base (3)..(3): base is a locked nucleic acid
  modified_base (4)..(4): base is a locked nucleic acid
  modified_base (5)..(5): base is a locked nucleic acid
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1730 - DNA, 40 bp, Artificial Sequence; identical to SEQ ID NO: 1674
  Pan degenerate oligonucleotide primer
  primer_bind (1)..(40)
  modified_base (2)..(2): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 70 to correspond to the nucleotides in an oligonucleotide probe downstream of the discriminating single nucleotide polymorphism.

SEQ ID NO: 1731 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.
tgagttctyttattragytcyctraartctacta

SEQ ID NO: 1732 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.
ytgagttctyttattragytcyctraartctacta

SEQ ID NO: 1733 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.
aartcytgagttctyttattragytcyctraartctacta

SEQ ID NO: 1734 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 74 to correspond to the nucleotides in an oligonucleotide probe downstream of the discriminating single nucleotide polymorphism.
yttattragytcyctraartctacta

SEQ ID NO: 1735 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ctyttattragytcyctraartctacta

SEQ ID NO: 1736 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.
gttctyttattragytcyctraartctacta

SEQ ID NO: 1737 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 74 to correspond to the nucleotides in an oligonucleotide probe downstream of the discriminating single nucleotide polymorphism.
ytgracytcccaraartcytgagttytyttattragytcyctraaatctac

SEQ ID NO: 1738 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tgagttctyttattragytcyctraartctactan

SEQ ID NO: 1739 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ytgagttctyttattragytcyctraartctactan

SEQ ID NO: 1740 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
aartcytgagttctyttattragytcyctraartctactan

SEQ ID NO: 1741 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
yttattragytcyctraartctactan

SEQ ID NO: 1742 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
ctyttattragytcyctraartctactan

SEQ ID NO: 1743 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
gttctyttattragytcyctraartctactan

SEQ ID NO: 1744 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 74 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ytgracytcccaraartcytgagttytyttattragytcyctraaatctacn

SEQ ID NO: 1745 - DNA, 34 bp, Artificial Sequence; identical to SEQ ID NO: 1731
  Pan degenerate oligonucleotide primer
  primer_bind (1)..(34)
  modified_base (1)..(1): base is a locked nucleic acid
  modified_base (4)..(4): base is a locked nucleic acid
  modified_base (9)..(9): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1746 - DNA, 34 bp, Artificial Sequence; identical to SEQ ID NO: 1731
  Pan degenerate oligonucleotide primer
  primer_bind (1)..(34)
  modified_base (1)..(1): base is a locked nucleic acid
  modified_base (7)..(7): base is a locked nucleic acid
  modified_base (9)..(9): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1747 - DNA, 34 bp, Artificial Sequence; identical to SEQ ID NO: 1731
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1748 - DNA, 35 bp, Artificial Sequence; identical to SEQ ID NO: 1732
  Pan degenerate oligonucleotide primer
  primer_bind (1)..(35)
  modified_base (1)..(1): base is a locked nucleic acid
  modified_base (2)..(2): base is a locked nucleic acid
  modified_base (8)..(8): base is a locked nucleic acid
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1749 - DNA, 35 bp, Artificial Sequence; identical to SEQ ID NO: 1732
  Pan degenerate oligonucleotide primer
  primer_bind (1)..(35)
  modified_base (1)..(1): base is a locked nucleic acid
  modified_base (5)..(5): base is a locked nucleic acid
  modified_base (8)..(8): base is a locked nucleic acid
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1750 - DNA, 35 bp, Artificial Sequence; identical to SEQ ID NO: 1732
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1751 - DNA, 40 bp, Artificial Sequence; identical to SEQ ID NO: 1733
  Pan degenerate oligonucleotide primer
  primer_bind (1)..(40)
  modified_base (1)..(1): base is a locked nucleic acid
  modified_base (6)..(6): base is a locked nucleic acid
  modified_base (10)..(10): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1752 - DNA, 40 bp, Artificial Sequence; identical to SEQ ID NO: 1733
  Pan degenerate oligonucleotide primer
  primer_bind (1)..(40)
  modified_base (1)..(1): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1753 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (5)..(5): base is a locked nucleic acid
  misc_feature (20)..(26): Adaptor region of the pan degenerate antisense primer that adapts the probe-binding site downstream of codon 74 to correspond to the nucleotides in an oligonucleotide probe downstream of the discriminating single nucleotide polymorphism.
yttattragytcyctraartctacta

SEQ ID NO: 1754 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (5)..(5): base is a locked nucleic acid
  misc_feature (20)..(26): Adaptor region of the pan degenerate antisense primer that adapts the probe-binding site downstream of codon 74 to correspond to the nucleotides in an oligonucleotide probe downstream of the discriminating single nucleotide polymorphism.
yttattragytcyctraartctacta

SEQ ID NO: 1755 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (4)..(4): base is a locked nucleic acid
  misc_feature (20)..(26): Adaptor region of the pan degenerate antisense primer that adapts the probe-binding site downstream of codon 74 to correspond to the nucleotides in an oligonucleotide probe downstream of the discriminating single nucleotide polymorphism.
yttattragytcyctraartctacta

SEQ ID NO: 1756 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (6)..(6): base is a locked nucleic acid
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ctyttattragytcyctraartctacta

SEQ ID NO: 1757 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ctyttattragytcyctraartctacta

SEQ ID NO: 1758 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 74 to correspond to the nucleotides in an oligonucleotide probe downstream of the discriminating single nucleotide polymorphism.
ctyttattragytcyctraartctacta

SEQ ID NO: 1759 - DNA, 31 bp, Artificial Sequence; identical to SEQ ID NO: 1736
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1760 - DNA, 31 bp, Artificial Sequence; identical to SEQ ID NO: 1736
  Pan degenerate oligonucleotide primer
  primer_bind (1)..(31)
  modified_base (1)..(1): base is a locked nucleic acid
  modified_base (6)..(6): base is a locked nucleic acid
  modified_base (7)..(7): base is a locked nucleic acid
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1761 - DNA, 31 bp, Artificial Sequence; identical to SEQ ID NO: 1736
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1762 - DNA, 40 bp, Artificial Sequence; identical to SEQ ID NO: 1733
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 74 to correspond to the nucleotides in an oligonucleotide probe downstream of the discriminating single nucleotide polymorphism.

SEQ ID NO: 1763 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 75 to correspond to the nucleotides in an oligonucleotide probe downstream of the discriminating single nucleotide polymorphism.
tcytgagttctyttattragytcyctraartcta

SEQ ID NO: 1764 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 75 to correspond to the nucleotides in an oligonucleotide probe downstream of the discriminating single nucleotide polymorphism.
artcytgagttctyttattragytcyctraartct

SEQ ID NO: 1765 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 75 to correspond to the nucleotides in an oligonucleotide probe downstream of the discriminating single nucleotide polymorphism.
aartcytgagttctyttattragytcyctraartcta

SEQ ID NO: 1766 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 75 to correspond to the nucleotides in an oligonucleotide probe downstream of the discriminating single nucleotide polymorphism.
araartcytgagttctyttattragytcyctraartct

SEQ ID NO: 1767 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.
caraartcytgagttctyttattragytcyctraartcta

SEQ ID NO: 1768 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.
ccaraartcytgagttctyttattragytcyctraartct

SEQ ID NO: 1769 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 75 to correspond to the nucleotides in an oligonucleotide probe downstream of the discriminating single nucleotide polymorphism.
gttctyttattragytcyctraartcta

SEQ ID NO: 1770 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
gagttctyttattragytcyctraartct

SEQ ID NO: 1771 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
agttctyttattragytcyctraartcta

SEQ ID NO: 1772 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 75 to correspond to the nucleotides in an oligonucleotide probe downstream of the discriminating single nucleotide polymorphism.
tgagttctyttattragytcyctraartct

SEQ ID NO: 1773 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 75 to correspond to the nucleotides in an oligonucleotide probe downstream of the discriminating single nucleotide polymorphism.
tgagttctyttattragytcyctraartcta

SEQ ID NO: 1774 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 75 to correspond to the nucleotides in an oligonucleotide probe downstream of the discriminating single nucleotide polymorphism.
cytgagttctyttattragytcyctraartct

SEQ ID NO: 1775 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 75 to correspond to the nucleotides in an oligonucleotide probe downstream of the discriminating single nucleotide polymorphism.
taaytgracytcccaraartcytgagttytyttattragytcyctgaaatc

SEQ ID NO: 1776 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tcytgagttctyttattragytcyctraartctan

SEQ ID NO: 1777 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
artcytgagttctyttattragytcyctraartctn

SEQ ID NO: 1778 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
aartcytgagttctyttattragytcyctraartctan

SEQ ID NO: 1779 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
araartcytgagttctyttattragytcyctraartctn

SEQ ID NO: 1780 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
caraartcytgagttctyttattragytcyctraartctan

SEQ ID NO: 1781 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ccaraartcytgagttctyttattragytcyctraartctn

SEQ ID NO: 1782 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
gttctyttattragytcyctraartctan

SEQ ID NO: 1783 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
gagttctyttattragytcyctraartctn

SEQ ID NO: 1784 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
agttctyttattragytcyctraartctan

SEQ ID NO: 1785 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tgagttctyttattragytcyctraartctn

SEQ ID NO: 1786 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
tgagttctyttattragytcyctraartctan

SEQ ID NO: 1787 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
cytgagttctyttattragytcyctraartctn

SEQ ID NO: 1788 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 75 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
taaytgracytcccaraartcytgagttytyttattragytcyctgaaatcn

SEQ ID NO: 1789 - DNA, 34 bp, Artificial Sequence; identical to SEQ ID NO: 1763
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1790 - DNA, 35 bp, Artificial Sequence; identical to SEQ ID NO: 1764
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1791 - DNA, 34 bp, Artificial Sequence; identical to SEQ ID NO: 1763
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1792 - DNA, 35 bp, Artificial Sequence; identical to SEQ ID NO: 1764
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1793 - DNA, 34 bp, Artificial Sequence; identical to SEQ ID NO: 1763
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1794 - DNA, 35 bp, Artificial Sequence; identical to SEQ ID NO: 1764
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1795 - DNA, 37 bp, Artificial Sequence; identical to SEQ ID NO: 1765
  Pan degenerate oligonucleotide primer
  primer_bind (1)..(37)
  modified_base (1)..(1): base is a locked nucleic acid
  modified_base (4)..(4): base is a locked nucleic acid
  modified_base (9)..(9): base is a locked nucleic acid
  misc_feature (31)..(37): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1796 - DNA, 38 bp, Artificial Sequence; identical to SEQ ID NO: 1766
  Pan degenerate oligonucleotide primer
  primer_bind (1)..(38)
  modified_base (1)..(1): base is a locked nucleic acid
  modified_base (4)..(4): base is a locked nucleic acid
  modified_base (9)..(9): base is a locked nucleic acid
  misc_feature (32)..(38): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1797 - DNA, 37 bp, Artificial Sequence; identical to SEQ ID NO: 1765
  Pan degenerate oligonucleotide primer
  primer_bind (1)..(37)
  modified_base (1)..(1): base is a locked nucleic acid
  modified_base (7)..(7): base is a locked nucleic acid
  modified_base (9)..(9): base is a locked nucleic acid
  misc_feature (31)..(37): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1798 - DNA, 38 bp, Artificial Sequence; identical to SEQ ID NO: 1766
  Pan degenerate oligonucleotide primer
  primer_bind (1)..(38)
  modified_base (1)..(1): base is a locked nucleic acid
  modified_base (7)..(7): base is a locked nucleic acid
  modified_base (9)..(9): base is a locked nucleic acid
  misc_feature (32)..(38): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1799 - DNA, 37 bp, Artificial Sequence; identical to SEQ ID NO: 1765
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1800 - DNA, 38 bp, Artificial Sequence; identical to SEQ ID NO: 1766
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1801 - DNA, 40 bp, Artificial Sequence; identical to SEQ ID NO: 1767
  Pan degenerate oligonucleotide primer
  primer_bind (1)..(40)
  modified_base (3)..(3): base is a locked nucleic acid
  modified_base (4)..(4): base is a locked nucleic acid
  modified_base (10)..(10): base is a locked nucleic acid
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1802 - DNA, 40 bp, Artificial Sequence; identical to SEQ ID NO: 1768
  Pan degenerate oligonucleotide primer
  primer_bind (1)..(40)
  modified_base (2)..(2): base is a locked nucleic acid
  modified_base (3)..(3): base is a locked nucleic acid
  modified_base (9)..(9): base is a locked nucleic acid
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1803 - DNA, 40 bp, Artificial Sequence; identical to SEQ ID NO: 1767
  Pan degenerate oligonucleotide primer
  primer_bind (1)..(40)
  modified_base (3)..(3): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1804 - DNA, 40 bp, Artificial Sequence; identical to SEQ ID NO: 1768
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1805 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (6)..(6): base is a locked nucleic acid
  misc_feature (22)..(28): Adaptor region of the pan degenerate antisense primer that adapts the probe-binding site downstream of codon 75 to correspond to the nucleotides in an oligonucleotide probe downstream of the discriminating single nucleotide polymorphism.
gttctyttattragytcyctraartcta

SEQ ID NO: 1806 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
gagttctyttattragytcyctraartct

SEQ ID NO: 1807 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 75 to correspond to the nucleotides in an oligonucleotide probe downstream of the discriminating single nucleotide polymorphism.
gttctyttattragytcyctraartcta

SEQ ID NO: 1808 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
gagttctyttattragytcyctraartct

SEQ ID NO: 1809 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 75 to correspond to the nucleotides in an oligonucleotide probe downstream of the discriminating single nucleotide polymorphism.
gttctyttattragytcyctraartcta

SEQ ID NO: 1810 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
gagttctyttattragytcyctraartct

SEQ ID NO: 1811 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
agttctyttattragytcyctraartcta

SEQ ID NO: 1812 - DNA, 30 bp, Artificial Sequence; identical to SEQ ID NO: 1772
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1813 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
agttctyttattragytcyctraartcta

SEQ ID NO: 1814 - DNA, 30 bp, Artificial Sequence; identical to SEQ ID NO: 1772
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1815 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 75 to correspond to the nucleotides in an oligonucleotide probe downstream of the discriminating single nucleotide polymorphism.
agttctyttattragytcyctraartcta

SEQ ID NO: 1816 - DNA, 30 bp, Artificial Sequence; identical to SEQ ID NO: 1772
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1817 - DNA, 31 bp, Artificial Sequence; identical to SEQ ID NO: 1773
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (25)..(31): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1818 - DNA, 32 bp, Artificial Sequence; identical to SEQ ID NO: 1774
  Pan degenerate oligonucleotide primer
  primer_bind (1)..(32)
  modified_base (1)..(1): base is a locked nucleic acid
  modified_base (3)..(3): base is a locked nucleic acid
  modified_base (6)..(6): base is a locked nucleic acid
  misc_feature (26)..(32): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1819 - DNA, 31 bp, Artificial Sequence; identical to SEQ ID NO: 1773
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1820 - DNA, 32 bp, Artificial Sequence; identical to SEQ ID NO: 1774
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1821 - DNA, 31 bp, Artificial Sequence; identical to SEQ ID NO: 1773
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1822 - DNA, 32 bp, Artificial Sequence; identical to SEQ ID NO: 1774
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1823 - DNA, 40 bp, Artificial Sequence; identical to SEQ ID NO: 1767
  Pan degenerate oligonucleotide primer
  primer_bind (1)..(40)
  modified_base (3)..(3): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1824 - DNA, 40 bp, Artificial Sequence; identical to SEQ ID NO: 1768
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 75 to correspond to the nucleotides in an oligonucleotide probe downstream of the discriminating single nucleotide polymorphism.

SEQ ID NO: 1825 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 77 to correspond to the nucleotides in an oligonucleotide probe downstream of the discriminating single nucleotide polymorphism.
ytcccaraartcytgagttctyttattragytcyct

SEQ ID NO: 1826 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 77 to correspond to the nucleotides in an oligonucleotide probe downstream of the discriminating single nucleotide polymorphism.
cytcccaraartcytgagttctyttattragytcyct

SEQ ID NO: 1827 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 77 to correspond to the nucleotides in an oligonucleotide probe downstream of the discriminating single nucleotide polymorphism.
gracytcccaraartcytgagttctyttattragytcyct

SEQ ID NO: 1828 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 77 to correspond to the nucleotides in an oligonucleotide probe downstream of the discriminating single nucleotide polymorphism.
araartcytgagttctyttattragytcyct

SEQ ID NO: 1829 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 77 to correspond to the nucleotides in an oligonucleotide probe downstream of the discriminating single nucleotide polymorphism.
ccaraartcytgagttctyttattragytcyct

SEQ ID NO: 1830 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 77 to correspond to the nucleotides in an oligonucleotide probe downstream of the discriminating single nucleotide polymorphism.
cccaraartcytgagttctyttattragytcyct

SEQ ID NO: 1831 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 77 to correspond to the nucleotides in an oligonucleotide probe downstream of the discriminating single nucleotide polymorphism.
tatycctaaytgracytcccaraartcytgagttytyttattragttctct

SEQ ID NO: 1832 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 77 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
ytcccaraartcytgagttctyttattragytcyctn

SEQ ID NO: 1833 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 77 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
cytcccaraartcytgagttctyttattragytcyctn

SEQ ID NO: 1834 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 77 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gracytcccaraartcytgagttctyttattragytcyctn

SEQ ID NO: 1835 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 77 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
araartcytgagttctyttattragytcyctn

SEQ ID NO: 1836 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 77 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
ccaraartcytgagttctyttattragytcyctn

SEQ ID NO: 1837 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 77 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
cccaraartcytgagttctyttattragytcyctn

SEQ ID NO: 1838 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 77 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tatycctaaytgracytcccaraartcytgagttytyttattragttctctn

SEQ ID NO: 1839 - DNA, 36 bp, Artificial Sequence; identical to SEQ ID NO: 1825
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1840 - DNA, 36 bp, Artificial Sequence; identical to SEQ ID NO: 1825
  Pan degenerate oligonucleotide primer
  primer_bind (1)..(36)
  modified_base (1)..(1): base is a locked nucleic acid
  modified_base (4)..(4): base is a locked nucleic acid
  modified_base (6)..(6): base is a locked nucleic acid
  misc_feature (30)..(36): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1841 - DNA, 36 bp, Artificial Sequence; identical to SEQ ID NO: 1825
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1842 - DNA, 37 bp, Artificial Sequence; identical to SEQ ID NO: 1826
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1843 - DNA, 37 bp, Artificial Sequence; identical to SEQ ID NO: 1826
  Pan degenerate oligonucleotide primer
  primer_bind (1)..(37)
  modified_base (1)..(1): base is a locked nucleic acid
  modified_base (4)..(4): base is a locked nucleic acid
  modified_base (5)..(5): base is a locked nucleic acid
  misc_feature (31)..(37): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1844 - DNA, 37 bp, Artificial Sequence; identical to SEQ ID NO: 1826
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1845 - DNA, 40 bp, Artificial Sequence; identical to SEQ ID NO: 1827
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1846 - DNA, 31 bp, Artificial Sequence; identical to SEQ ID NO: 1828
  Pan degenerate oligonucleotide primer
  primer_bind (1)..(31)
  modified_base (1)..(1): base is a locked nucleic acid
  modified_base (2)..(2): base is a locked nucleic acid
  modified_base (7)..(7): base is a locked nucleic acid
  misc_feature (25)..(31): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1847 - DNA, 31 bp, Artificial Sequence; identical to SEQ ID NO: 1828
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1848 - DNA, 31 bp, Artificial Sequence; identical to SEQ ID NO: 1828
  Pan degenerate oligonucleotide primer
  primer_bind (1)..(31)
  modified_base (1)..(1): base is a locked nucleic acid
  modified_base (2)..(2): base is a locked nucleic acid
  modified_base (4)..(4): base is a locked nucleic acid
  misc_feature (25)..(31): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1849 - DNA, 33 bp, Artificial Sequence; identical to SEQ ID NO: 1829
  Pan degenerate oligonucleotide primer
  primer_bind (1)..(33)
  modified_base (1)..(1): base is a locked nucleic acid
  modified_base (3)..(3): base is a locked nucleic acid
  modified_base (6)..(6): base is a locked nucleic acid
  misc_feature (27)..(33): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1850 - DNA, 33 bp, Artificial Sequence; identical to SEQ ID NO: 1829
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1851 - DNA, 33 bp, Artificial Sequence; identical to SEQ ID NO: 1829
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1852 - DNA, 34 bp, Artificial Sequence; identical to SEQ ID NO: 1830
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1853 - DNA, 34 bp, Artificial Sequence; identical to SEQ ID NO: 1830
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1854 - DNA, 34 bp, Artificial Sequence; identical to SEQ ID NO: 1830
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1855 - DNA, 40 bp, Artificial Sequence; identical to SEQ ID NO: 1827
  Pan degenerate oligonucleotide primer
  primer_bind (1)..(40)
  modified_base (2)..(2): base is a locked nucleic acid
  modified_base (4)..(4): base is a locked nucleic acid
  modified_base (5)..(5): base is a locked nucleic acid
  misc_feature (34)..(40): Adaptor region of the pan degenerate antisense primer that adapts the probe-binding site downstream of codon 77 to correspond to the nucleotides in an oligonucleotide probe downstream of the discriminating single nucleotide polymorphism.

SEQ ID NO: 1856 - DNA, 37 bp, Artificial Sequence
  Pan degenerate oligonucleotide primer
  primer_bind (1)..(37)
  misc_feature (21)..(21): n is a, c, g, or t
  misc_feature (31)..(37): Adaptor region of the pan degenerate antisense primer that adapts the probe-binding site downstream of codon 90 to correspond to the nucleotides in an oligonucleotide probe downstream of the discriminating single nucleotide polymorphism.
ttttttarhccygcdggrtgnggtatycctaattgra

SEQ ID NO: 1857 - DNA, 38 bp, Artificial Sequence
  Pan degenerate oligonucleotide primer
  primer_bind (1)..(38)
  misc_feature (22)..(22): n is a, c, g, or t
  misc_feature (32)..(38): Adaptor region of the pan degenerate antisense primer that adapts the probe-binding site downstream of codon 90 to correspond to the nucleotides in an oligonucleotide probe downstream of the discriminating single nucleotide polymorphism.
cttttttarhccygcdggrtgnggtatycctaattgra

SEQ ID NO: 1858 - DNA, 40 bp, Artificial Sequence
  Pan degenerate oligonucleotide primer
  primer_bind (1)..(40)
  misc_feature (24)..(24): n is a, c, g, or t
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.
ttcttttttarhccygcdggrtgnggtatycctaattgra

SEQ ID NO: 1859 - DNA, 31 bp, Artificial Sequence
  Pan degenerate oligonucleotide primer
  primer_bind (1)..(31)
  misc_feature (15)..(15): n is a, c, g, or t
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.
arhccygcdggrtgnggtatycctaattgra

SEQ ID NO: 1860 - DNA, 32 bp, Artificial Sequence
  Pan degenerate oligonucleotide primer
  primer_bind (1)..(32)
  misc_feature (16)..(16): n is a, c, g, or t
  misc_feature (26)..(32): Adaptor region of the pan degenerate antisense primer that adapts the probe-binding site downstream of codon 90 to correspond to the nucleotides in an oligonucleotide probe downstream of the discriminating single nucleotide polymorphism.
tarhccygcdggrtgnggtatycctaattgra

SEQ ID NO: 1861 - DNA, 34 bp, Artificial Sequence
  Pan degenerate oligonucleotide primer
  primer_bind (1)..(34)
  misc_feature (18)..(18): n is a, c, g, or t
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.
tttarhccygcdggrtgnggtatycctaattgra

SEQ ID NO: 1862 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 90 to correspond to the nucleotides in an oligonucleotide probe downstream of the discriminating single nucleotide polymorphism.
gtyacwgayttyttcttytttarhccygcdggrtghggtatycctaattg

SEQ ID NO: 1863 - DNA, 38 bp, Artificial Sequence
  Pan degenerate oligonucleotide primer
  primer_bind (1)..(38)
  misc_feature (21)..(21): n is a, c, g, or t
  misc_feature (31)..(37): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ttttttarhccygcdggrtgnggtatycctaattgran

SEQ ID NO: 1864 - DNA, 39 bp, Artificial Sequence
  Pan degenerate oligonucleotide primer
  primer_bind (1)..(39)
  misc_feature (22)..(22): n is a, c, g, or t
  misc_feature (32)..(38): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
cttttttarhccygcdggrtgnggtatycctaattgran

SEQ ID NO: 1865 - DNA, 41 bp, Artificial Sequence
  Pan degenerate oligonucleotide primer
  primer_bind (1)..(41)
  misc_feature (24)..(24): n is a, c, g, or t
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ttcttttttarhccygcdggrtgnggtatycctaattgran

SEQ ID NO: 1866 - DNA, 32 bp, Artificial Sequence
  Pan degenerate oligonucleotide primer
  primer_bind (1)..(32)
  misc_feature (15)..(15): n is a, c, g, or t
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
arhccygcdggrtgnggtatycctaattgran

SEQ ID NO: 1867 - DNA, 33 bp, Artificial Sequence
  Pan degenerate oligonucleotide primer
  primer_bind (1)..(33)
  misc_feature (16)..(16): n is a, c, g, or t
  misc_feature (26)..(32): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tarhccygcdggrtgnggtatycctaattgran

SEQ ID NO: 1868 - DNA, 35 bp, Artificial Sequence
  Pan degenerate oligonucleotide primer
  primer_bind (1)..(35)
  misc_feature (18)..(18): n is a, c, g, or t
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tttarhccygcdggrtgnggtatycctaattgran

SEQ ID NO: 1869 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 90 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
gtyacwgayttyttcttytttarhccygcdggrtghggtatycctaattgn

SEQ ID NO: 1870 - DNA, 37 bp, Artificial Sequence; identical to SEQ ID NO: 1856
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (21)..(21): n is a, c, g, or t
  misc_feature (31)..(37): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1871 - DNA, 37 bp, Artificial Sequence; identical to SEQ ID NO: 1856
  Pan degenerate oligonucleotide primer
  primer_bind (1)..(37)
  modified_base (1)..(1): base is a locked nucleic acid
  modified_base (6)..(6): base is a locked nucleic acid
  modified_base (7)..(7): base is a locked nucleic acid
  misc_feature (21)..(21): n is a, c, g, or t
  misc_feature (31)..(37): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1872 - DNA, 37 bp, Artificial Sequence; identical to SEQ ID NO: 1856
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (21)..(21): n is a, c, g, or t
  misc_feature (31)..(37): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1873 - DNA, 38 bp, Artificial Sequence; identical to SEQ ID NO: 1857
  Pan degenerate oligonucleotide primer
  primer_bind (1)..(38)
  modified_base (1)..(1): base is a locked nucleic acid
  modified_base (2)..(2): base is a locked nucleic acid
  modified_base (7)..(7): base is a locked nucleic acid
  misc_feature (22)..(22): n is a, c, g, or t
  misc_feature (32)..(38): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1874 - DNA, 38 bp, Artificial Sequence; identical to SEQ ID NO: 1857
  Pan degenerate oligonucleotide primer
  primer_bind (1)..(38)
  modified_base (1)..(1): base is a locked nucleic acid
  modified_base (5)..(5): base is a locked nucleic acid
  modified_base (7)..(7): base is a locked nucleic acid
  misc_feature (22)..(22): n is a, c, g, or t
  misc_feature (32)..(38): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1875 - DNA, 38 bp, Artificial Sequence; identical to SEQ ID NO: 1857
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (22)..(22): n is a, c, g, or t
  misc_feature (32)..(38): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1876 - DNA, 40 bp, Artificial Sequence; identical to SEQ ID NO: 1858
  Pan degenerate oligonucleotide primer
  primer_bind (1)..(40)
  modified_base (3)..(3): base is a locked nucleic acid
  modified_base (4)..(4): base is a locked nucleic acid
  modified_base (9)..(9): base is a locked nucleic acid
  misc_feature (24)..(24): n is a, c, g, or t
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1877 - DNA, 40 bp, Artificial Sequence; identical to SEQ ID NO: 1858
  Pan degenerate oligonucleotide primer
  primer_bind (1)..(40)
  modified_base (4)..(4): base is a locked nucleic acid
  modified_base (7)..(7): base is a locked nucleic acid
  modified_base (9)..(9): base is a locked nucleic acid
  misc_feature (24)..(24): n is a, c, g, or t
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1878 - DNA, 31 bp, Artificial Sequence; identical to SEQ ID NO: 1859
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (15)..(15): n is a, c, g, or t
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1879 - DNA, 31 bp, Artificial Sequence; identical to SEQ ID NO: 1859
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (15)..(15): n is a, c, g, or t
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1880 - DNA, 31 bp, Artificial Sequence; identical to SEQ ID NO: 1859
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (15)..(15): n is a, c, g, or t
  misc_feature (25)..(31): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1881 - DNA, 32 bp, Artificial Sequence; identical to SEQ ID NO: 1860
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (16)..(16): n is a, c, g, or t
  misc_feature (26)..(32): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1882 - DNA, 32 bp, Artificial Sequence; identical to SEQ ID NO: 1860
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (16)..(16): n is a, c, g, or t
  misc_feature (26)..(32): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1883 - DNA, 32 bp, Artificial Sequence; identical to SEQ ID NO: 1860
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (16)..(16): n is a, c, g, or t
  misc_feature (26)..(32): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1884 - DNA, 34 bp, Artificial Sequence; identical to SEQ ID NO: 1861
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (18)..(18): n is a, c, g, or t
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1885 - DNA, 34 bp, Artificial Sequence; identical to SEQ ID NO: 1861
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (18)..(18): n is a, c, g, or t
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1886 - DNA, 34 bp, Artificial Sequence; identical to SEQ ID NO: 1861
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (18)..(18): n is a, c, g, or t
  misc_feature (28)..(34): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1887 - DNA, 40 bp, Artificial Sequence; identical to SEQ ID NO: 1858
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (24)..(24): n is a, c, g, or t
  misc_feature (34)..(40): Adaptor region of the pan degenerate antisense primer that adapts the probe-binding site downstream of codon 90 to correspond to the nucleotides in an oligonucleotide probe downstream of the discriminating single nucleotide polymorphism.

SEQ ID NO: 1888 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 98 to correspond to the nucleotides in an oligonucleotide probe downstream of the discriminating single nucleotide polymorphism.
cyaryactgtyactgayttkttcttttttarhccy

SEQ ID NO: 1889 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 98 to correspond to the nucleotides in an oligonucleotide probe downstream of the discriminating single nucleotide polymorphism.
catcyaryactgtyactgayttkttcttttttarhccy

SEQ ID NO: 1890 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 98 to correspond to the nucleotides in an oligonucleotide probe downstream of the discriminating single nucleotide polymorphism.
yacatcyaryactgtyactgayttkttcttttttarhccy

SEQ ID NO: 1891 - DNA, 20 bp, Artificial Sequence
  Pan degenerate oligonucleotide primer
  primer_bind (1)..(20)
  misc_feature (14)..(20): Adaptor region of the pan degenerate antisense primer that adapts the probe-binding site downstream of codon 98 to correspond to the nucleotides in an oligonucleotide probe downstream of the discriminating single nucleotide polymorphism.
ayttkttcttttttarhccy

SEQ ID NO: 1892 - DNA, 24 bp, Artificial Sequence
  Pan degenerate oligonucleotide primer
  primer_bind (1)..(24)
  misc_feature (18)..(24): Adaptor region of the pan degenerate antisense primer that adapts the probe-binding site downstream of codon 98 to correspond to the nucleotides in an oligonucleotide probe downstream of the discriminating single nucleotide polymorphism.
actgayttkttcttttttarhccy

SEQ ID NO: 1893 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 98 to correspond to the nucleotides in an oligonucleotide probe downstream of the discriminating single nucleotide polymorphism.
gtyactgayttkttcttttttarhccy

SEQ ID NO: 1894 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 98 to correspond to the nucleotides in an oligonucleotide probe downstream of the discriminating single nucleotide polymorphism.
rtatgcatchccyacatcyarbactgtyacwgayttyttcttytttaaccc

SEQ ID NO: 1895 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 98 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
cyaryactgtyactgayttkttcttttttarhccyn

SEQ ID NO: 1896 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 98 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
catcyaryactgtyactgayttkttcttttttarhccyn

SEQ ID NO: 1897 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 98 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yacatcyaryactgtyactgayttkttcttttttarhccyn

SEQ ID NO: 1898 - DNA, 21 bp, Artificial Sequence
  Pan degenerate oligonucleotide primer
  primer_bind (1)..(21)
  misc_feature (14)..(20): Adaptor region of the pan degenerate antisense primer that adapts the probe-binding site downstream of codon 98 to correspond to the nucleotides in an oligonucleotide probe downstream of the discriminating single nucleotide polymorphism.
  modified_base (21)..(21): base is a locked nucleic acid
  misc_feature (21)..(21): n is a, c, g, or t
ayttkttcttttttarhccyn

SEQ ID NO: 1899 - DNA, 25 bp, Artificial Sequence
  Pan degenerate oligonucleotide primer
  primer_bind (1)..(25)
  misc_feature (18)..(24): Adaptor region of the pan degenerate antisense primer that adapts the probe-binding site downstream of codon 98 to correspond to the nucleotides in an oligonucleotide probe downstream of the discriminating single nucleotide polymorphism.
  modified_base (25)..(25): base is a locked nucleic acid
  misc_feature (25)..(25): n is a, c, g, or t
actgayttkttcttttttarhccyn

SEQ ID NO: 1900 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 98 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
gtyactgayttkttcttttttarhccyn

SEQ ID NO: 1901 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 98 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rtatgcatchccyacatcyarbactgtyacwgayttyttcttytttaacccn

SEQ ID NO: 1902 - DNA, 35 bp, Artificial Sequence; identical to SEQ ID NO: 1888
  Pan degenerate oligonucleotide primer
  primer_bind (1)..(35)
  modified_base (1)..(1): base is a locked nucleic acid
  modified_base (9)..(9): base is a locked nucleic acid
  modified_base (16)..(16): base is a locked nucleic acid
  misc_feature (29)..(35): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1903 - DNA, 35 bp, Artificial Sequence; identical to SEQ ID NO: 1888
  Pan degenerate oligonucleotide primer
  primer_bind (1)..(35)
  modified_base (1)..(1): base is a locked nucleic acid
  modified_base (12)..(12): base is a locked nucleic acid
  modified_base (16)..(16): base is a locked nucleic acid
  misc_feature (29)..(35): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1904 - DNA, 35 bp, Artificial Sequence; identical to SEQ ID NO: 1888
  Pan degenerate oligonucleotide primer
  primer_bind (1)..(35)
  modified_base (1)..(1): base is a locked nucleic acid
  modified_base (9)..(9): base is a locked nucleic acid
  modified_base (12)..(12): base is a locked nucleic acid
  misc_feature (29)..(35): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1905 - DNA, 38 bp, Artificial Sequence; identical to SEQ ID NO: 1889
  Pan degenerate oligonucleotide primer
  primer_bind (1)..(38)
  modified_base (1)..(1): base is a locked nucleic acid
  modified_base (4)..(4): base is a locked nucleic acid
  modified_base (15)..(15): base is a locked nucleic acid
  misc_feature (32)..(38): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1906 - DNA, 38 bp, Artificial Sequence; identical to SEQ ID NO: 1889
  Pan degenerate oligonucleotide primer
  primer_bind (1)..(38)
  modified_base (1)..(1): base is a locked nucleic acid
  modified_base (12)..(12): base is a locked nucleic acid
  modified_base (15)..(15): base is a locked nucleic acid
  misc_feature (32)..(38): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1907 - DNA, 38 bp, Artificial Sequence; identical to SEQ ID NO: 1889
  Pan degenerate oligonucleotide primer
  primer_bind (1)..(38)
  modified_base (1)..(1): base is a locked nucleic acid
  modified_base (4)..(4): base is a locked nucleic acid
  modified_base (12)..(12): base is a locked nucleic acid
  misc_feature (32)..(38): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1908 - DNA, 40 bp, Artificial Sequence; identical to SEQ ID NO: 1890
  Pan degenerate oligonucleotide primer
  primer_bind (1)..(40)
  modified_base (2)..(2): base is a locked nucleic acid
  modified_base (3)..(3): base is a locked nucleic acid
  modified_base (14)..(14): base is a locked nucleic acid
  misc_feature (34)..(40): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1909 - DNA, 40 bp, Artificial Sequence; identical to SEQ ID NO: 1890
  Pan degenerate oligonucleotide primer
  primer_bind (1)..(40)
  modified_base (2)..(2): base is a locked nucleic acid
  modified_base (6)..(6): base is a locked nucleic acid
  modified_base (14)..(14): base is a locked nucleic acid
  misc_feature (34)..(40): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1910 - DNA, 20 bp, Artificial Sequence
  Pan degenerate oligonucleotide primer
  primer_bind (1)..(20)
  modified_base (1)..(1): base is a locked nucleic acid
  modified_base (7)..(7): base is a locked nucleic acid
  modified_base (13)..(13): base is a locked nucleic acid
  misc_feature (14)..(20): Adaptor region of the pan degenerate antisense primer that adapts the probe-binding site downstream of codon 98 to correspond to the nucleotides in an oligonucleotide probe downstream of the discriminating single nucleotide polymorphism.
ayttkttcttttttarhccy

SEQ ID NO: 1911 - DNA, 20 bp, Artificial Sequence
  Pan degenerate oligonucleotide primer
  primer_bind (1)..(20)
  modified_base (1)..(1): base is a locked nucleic acid
  modified_base (10)..(10): base is a locked nucleic acid
  modified_base (13)..(13): base is a locked nucleic acid
  misc_feature (14)..(20): Adaptor region of the pan degenerate antisense primer that adapts the probe-binding site downstream of codon 98 to correspond to the nucleotides in an oligonucleotide probe downstream of the discriminating single nucleotide polymorphism.
ayttkttcttttttarhccy

SEQ ID NO: 1912 - DNA, 20 bp, Artificial Sequence
  Pan degenerate oligonucleotide primer
  primer_bind (1)..(20)
  modified_base (1)..(1): base is a locked nucleic acid
  modified_base (7)..(7): base is a locked nucleic acid
  modified_base (10)..(10): base is a locked nucleic acid
  misc_feature (14)..(20): Adaptor region of the pan degenerate antisense primer that adapts the probe-binding site downstream of codon 98 to correspond to the nucleotides in an oligonucleotide probe downstream of the discriminating single nucleotide polymorphism.
ayttkttcttttttarhccy

SEQ ID NO: 1913 - DNA, 24 bp, Artificial Sequence
  Pan degenerate oligonucleotide primer
  primer_bind (1)..(24)
  modified_base (1)..(1): base is a locked nucleic acid
  modified_base (5)..(5): base is a locked nucleic acid
  modified_base (14)..(14): base is a locked nucleic acid
  misc_feature (18)..(24): Adaptor region of the pan degenerate antisense primer that adapts the probe-binding site downstream of codon 98 to correspond to the nucleotides in an oligonucleotide probe downstream of the discriminating single nucleotide polymorphism.
actgayttkttcttttttarhccy

SEQ ID NO: 1914 - DNA, 24 bp, Artificial Sequence
  Pan degenerate oligonucleotide primer
  primer_bind (1)..(24)
  modified_base (1)..(1): base is a locked nucleic acid
  modified_base (11)..(11): base is a locked nucleic acid
  modified_base (14)..(14): base is a locked nucleic acid
  misc_feature (18)..(24): Adaptor region of the pan degenerate antisense primer that adapts the probe-binding site downstream of codon 98 to correspond to the nucleotides in an oligonucleotide probe downstream of the discriminating single nucleotide polymorphism.
actgayttkttcttttttarhccy

SEQ ID NO: 1915 - DNA, 24 bp, Artificial Sequence
  Pan degenerate oligonucleotide primer
  primer_bind (1)..(24)
  modified_base (1)..(1): base is a locked nucleic acid
  modified_base (5)..(5): base is a locked nucleic acid
  modified_base (11)..(11): base is a locked nucleic acid
  misc_feature (18)..(24): Adaptor region of the pan degenerate antisense primer that adapts the probe-binding site downstream of codon 98 to correspond to the nucleotides in an oligonucleotide probe downstream of the discriminating single nucleotide polymorphism.
actgayttkttcttttttarhccy

SEQ ID NO: 1916 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (14)..(14): base is a locked nucleic acid
  misc_feature (21)..(27): Adaptor region of the pan degenerate antisense primer that adapts the probe-binding site downstream of codon 98 to correspond to the nucleotides in an oligonucleotide probe downstream of the discriminating single nucleotide polymorphism.
gtyactgayttkttcttttttarhccy

SEQ ID NO: 1917 - DNA, 27 bp, Artificial Sequence
  Pan degenerate oligonucleotide primer
  primer_bind (1)..(27)
  modified_base (1)..(1): base is a locked nucleic acid
  modified_base (8)..(8): base is a locked nucleic acid
  modified_base (14)..(14): base is a locked nucleic acid
  misc_feature (21)..(27): Adaptor region of the pan degenerate antisense primer that adapts the probe-binding site downstream of codon 98 to correspond to the nucleotides in an oligonucleotide probe downstream of the discriminating single nucleotide polymorphism.
gtyactgayttkttcttttttarhccy

SEQ ID NO: 1918 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (8)..(8): base is a locked nucleic acid
  misc_feature (21)..(27): Adaptor region of the pan degenerate antisense primer that adapts the probe-binding site downstream of codon 98 to correspond to the nucleotides in an oligonucleotide probe downstream of the discriminating single nucleotide polymorphism.
gtyactgayttkttcttttttarhccy

SEQ ID NO: 1919 - DNA, 40 bp, Artificial Sequence; identical to SEQ ID NO: 1890
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 98 to correspond to the nucleotides in an oligonucleotide probe downstream of the discriminating single nucleotide polymorphism.

SEQ ID NO: 1920 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 100 to correspond to the nucleotides in an oligonucleotide probe downstream of the discriminating single nucleotide polymorphism.
yaryactgtyactgayttkttctttttta

SEQ ID NO: 1921 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 100 to correspond to the nucleotides in an oligonucleotide probe downstream of the discriminating single nucleotide polymorphism.
atcyaryactgtyactgayttkttctttttta

SEQ ID NO: 1922 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 100 to correspond to the nucleotides in an oligonucleotide probe downstream of the discriminating single nucleotide polymorphism.
tchccyacatcyaryactgtyactgayttkttctttttta

SEQ ID NO: 1923 - DNA, 16 bp, Artificial Sequence
  Pan degenerate oligonucleotide primer
  primer_bind (1)..(16)
  misc_feature (10)..(16): Adaptor region of the pan degenerate antisense primer that adapts the probe-binding site downstream of codon 100 to correspond to the nucleotides in an oligonucleotide probe downstream of the discriminating single nucleotide polymorphism.
gayttkttctttttta

SEQ ID NO: 1924 - DNA, 19 bp, Artificial Sequence
  Pan degenerate oligonucleotide primer
  primer_bind (1)..(19)
  misc_feature (13)..(19): Adaptor region of the pan degenerate antisense primer that adapts the probe-binding site downstream of codon 100 to correspond to the nucleotides in an oligonucleotide probe downstream of the discriminating single nucleotide polymorphism.
actgayttkttctttttta

SEQ ID NO: 1925 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 100 to correspond to the nucleotides in an oligonucleotide probe downstream of the discriminating single nucleotide polymorphism.
actgtyactgayttkttctttttta

SEQ ID NO: 1926 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 100 to correspond to the nucleotides in an oligonucleotide probe downstream of the discriminating single nucleotide polymorphism.
garaartatgcatchccyacatcyarbactgtyacwgayttyttcttttt

SEQ ID NO: 1927 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 100 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
yaryactgtyactgayttkttcttttttan

SEQ ID NO: 1928 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 100 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
atcyaryactgtyactgayttkttcttttttan

SEQ ID NO: 1929 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 100 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tchccyacatcyaryactgtyactgayttkttcttttttan

SEQ ID NO: 1930 - DNA, 17 bp, Artificial Sequence
  Pan degenerate oligonucleotide primer
  primer_bind (1)..(17)
  misc_feature (10)..(16): Adaptor region of the pan degenerate antisense primer that adapts the probe-binding site downstream of codon 100 to correspond to the nucleotides in an oligonucleotide probe downstream of the discriminating single nucleotide polymorphism.
  modified_base (17)..(17): base is a locked nucleic acid
  misc_feature (17)..(17): n is a, c, g, or t
gayttkttcttttttan

SEQ ID NO: 1931 - DNA, 20 bp, Artificial Sequence
  Pan degenerate oligonucleotide primer
  primer_bind (1)..(20)
  misc_feature (13)..(19): Adaptor region of the pan degenerate antisense primer that adapts the probe-binding site downstream of codon 100 to correspond to the nucleotides in an oligonucleotide probe downstream of the discriminating single nucleotide polymorphism.
  modified_base (20)..(20): base is a locked nucleic acid
  misc_feature (20)..(20): n is a, c, g, or t
actgayttkttcttttttan

SEQ ID NO: 1932 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 100 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
actgtyactgayttkttcttttttan

SEQ ID NO: 1933 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 100 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
garaartatgcatchccyacatcyarbactgtyacwgayttyttctttttn

SEQ ID NO: 1934 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (14)..(14): base is a locked nucleic acid
  misc_feature (23)..(29): Adaptor region of the pan degenerate antisense primer that adapts the probe-binding site downstream of codon 100 to correspond to the nucleotides in an oligonucleotide probe downstream of the discriminating single nucleotide polymorphism.
yaryactgtyactgayttkttctttttta

SEQ ID NO: 1935 - DNA, 29 bp, Artificial Sequence
  Pan degenerate oligonucleotide primer
  primer_bind (1)..(29)
  modified_base (1)..(1): base is a locked nucleic acid
  modified_base (11)..(11): base is a locked nucleic acid
  modified_base (14)..(14): base is a locked nucleic acid
  misc_feature (23)..(29): Adaptor region of the pan degenerate antisense primer that adapts the probe-binding site downstream of codon 100 to correspond to the nucleotides in an oligonucleotide probe downstream of the discriminating single nucleotide polymorphism.
yaryactgtyactgayttkttctttttta

SEQ ID NO: 1936 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (11)..(11): base is a locked nucleic acid
  misc_feature (23)..(29): Adaptor region of the pan degenerate antisense primer that adapts the probe-binding site downstream of codon 100 to correspond to the nucleotides in an oligonucleotide probe downstream of the discriminating single nucleotide polymorphism.
yaryactgtyactgayttkttctttttta

SEQ ID NO: 1937 - DNA, 32 bp, Artificial Sequence; identical to SEQ ID NO: 1921
  Pan degenerate oligonucleotide primer
  primer_bind (1)..(32)
  modified_base (1)..(1): base is a locked nucleic acid
  modified_base (4)..(4): base is a locked nucleic acid
  modified_base (14)..(14): base is a locked nucleic acid
  misc_feature (26)..(32): Adaptor region of the pan degenerate antisense primer that adapts the probe-binding site downstream of codon 100 to correspond to the nucleotides in an oligonucleotide probe downstream of the discriminating single nucleotide polymorphism.

SEQ ID NO: 1938 - DNA, 32 bp, Artificial Sequence; identical to SEQ ID NO: 1921
  Pan degenerate oligonucleotide primer
  primer_bind (1)..(32)
  modified_base (1)..(1): base is a locked nucleic acid
  modified_base (8)..(8): base is a locked nucleic acid
  modified_base (14)..(14): base is a locked nucleic acid
  misc_feature (26)..(32): Adaptor region of the pan degenerate antisense primer that adapts the probe-binding site downstream of codon 100 to correspond to the nucleotides in an oligonucleotide probe downstream of the discriminating single nucleotide polymorphism.

SEQ ID NO: 1939 - DNA, 32 bp, Artificial Sequence; identical to SEQ ID NO: 1921
  Pan degenerate oligonucleotide primer
  primer_bind (1)..(32)
  modified_base (1)..(1): base is a locked nucleic acid
  modified_base (4)..(4): base is a locked nucleic acid
  modified_base (8)..(8): base is a locked nucleic acid
  misc_feature (26)..(32): Adaptor region of the pan degenerate antisense primer that adapts the probe-binding site downstream of codon 100 to correspond to the nucleotides in an oligonucleotide probe downstream of the discriminating single nucleotide polymorphism.

SEQ ID NO: 1940 - DNA, 40 bp, Artificial Sequence; identical to SEQ ID NO: 1922
  Pan degenerate oligonucleotide primer
  primer_bind (1)..(40)
  modified_base (1)..(1): base is a locked nucleic acid
  modified_base (9)..(9): base is a locked nucleic acid
  modified_base (16)..(16): base is a locked nucleic acid
  misc_feature (34)..(40): Adaptor region of the pan degenerate antisense primer that adapts the probe-binding site downstream of codon 100 to correspond to the nucleotides in an oligonucleotide probe downstream of the discriminating single nucleotide polymorphism.

SEQ ID NO: 1941 - DNA, 40 bp, Artificial Sequence; identical to SEQ ID NO: 1922
  Pan degenerate oligonucleotide primer
  primer_bind (1)..(40)
  modified_base (1)..(1): base is a locked nucleic acid
  modified_base (12)..(12): base is a locked nucleic acid
  modified_base (16)..(16): base is a locked nucleic acid
  misc_feature (34)..(40): Adaptor region of the pan degenerate antisense primer that adapts the probe-binding site downstream of codon 100 to correspond to the nucleotides in an oligonucleotide probe downstream of the discriminating single nucleotide polymorphism.

SEQ ID NO: 1942 - DNA, 16 bp, Artificial Sequence
  Pan degenerate oligonucleotide primer
  primer_bind (1)..(16)
  modified_base (1)..(1): base is a locked nucleic acid
  modified_base (4)..(4): base is a locked nucleic acid
  modified_base (7)..(7): base is a locked nucleic acid
  misc_feature (10)..(16): Adaptor region of the pan degenerate antisense primer that adapts the probe-binding site downstream of codon 100 to correspond to the nucleotides in an oligonucleotide probe downstream of the discriminating single nucleotide polymorphism.
gayttkttctttttta

SEQ ID NO: 1943 - DNA, 16 bp, Artificial Sequence
  Pan degenerate oligonucleotide primer
  primer_bind (1)..(16)
  modified_base (1)..(1): base is a locked nucleic acid
  modified_base (6)..(6): base is a locked nucleic acid
  modified_base (7)..(7): base is a locked nucleic acid
  misc_feature (10)..(16): Adaptor region of the pan degenerate antisense primer that adapts the probe-binding site downstream of codon 100 to correspond to the nucleotides in an oligonucleotide probe downstream of the discriminating single nucleotide polymorphism.
gayttkttctttttta

SEQ ID NO: 1944 - DNA, 16 bp, Artificial Sequence
  Pan degenerate oligonucleotide primer
  primer_bind (1)..(16)
  modified_base (1)..(1): base is a locked nucleic acid
  modified_base (4)..(4): base is a locked nucleic acid
  modified_base (6)..(6): base is a locked nucleic acid
  misc_feature (10)..(16): Adaptor region of the pan degenerate antisense primer that adapts the probe-binding site downstream of codon 100 to correspond to the nucleotides in an oligonucleotide probe downstream of the discriminating single nucleotide polymorphism.
gayttkttctttttta

SEQ ID NO: 1945 - DNA, 19 bp, Artificial Sequence
  Pan degenerate oligonucleotide primer
  primer_bind (1)..(19)
  modified_base (1)..(1): base is a locked nucleic acid
  modified_base (4)..(4): base is a locked nucleic acid
  modified_base (9)..(9): base is a locked nucleic acid
  misc_feature (13)..(19): Adaptor region of the pan degenerate antisense primer that adapts the probe-binding site downstream of codon 100 to correspond to the nucleotides in an oligonucleotide probe downstream of the discriminating single nucleotide polymorphism.
actgayttkttctttttta

SEQ ID NO: 1946 - DNA, 19 bp, Artificial Sequence
  Pan degenerate oligonucleotide primer
  primer_bind (1)..(19)
  modified_base (1)..(1): base is a locked nucleic acid
  modified_base (7)..(7): base is a locked nucleic acid
  modified_base (9)..(9): base is a locked nucleic acid
  misc_feature (13)..(19): Adaptor region of the pan degenerate antisense primer that adapts the probe-binding site downstream of codon 100 to correspond to the nucleotides in an oligonucleotide probe downstream of the discriminating single nucleotide polymorphism.
actgayttkttctttttta

SEQ ID NO: 1947 - DNA, 19 bp, Artificial Sequence
  Pan degenerate oligonucleotide primer
  primer_bind (1)..(19)
  modified_base (1)..(1): base is a locked nucleic acid
  modified_base (4)..(4): base is a locked nucleic acid
  modified_base (7)..(7): base is a locked nucleic acid
  misc_feature (13)..(19): Adaptor region of the pan degenerate antisense primer that adapts the probe-binding site downstream of codon 100 to correspond to the nucleotides in an oligonucleotide probe downstream of the discriminating single nucleotide polymorphism.
actgayttkttctttttta

SEQ ID NO: 1948 - DNA, 25 bp, Artificial Sequence
  Pan degenerate oligonucleotide primer
  primer_bind (1)..(25)
  modified_base (1)..(1): base is a locked nucleic acid
  modified_base (7)..(7): base is a locked nucleic acid
  modified_base (13)..(13): base is a locked nucleic acid
  misc_feature (19)..(25): Adaptor region of the pan degenerate antisense primer that adapts the probe-binding site downstream of codon 100 to correspond to the nucleotides in an oligonucleotide probe downstream of the discriminating single nucleotide polymorphism.
actgtyactgayttkttctttttta

SEQ ID NO: 1949 - DNA, 25 bp, Artificial Sequence
  Pan degenerate oligonucleotide primer
  primer_bind (1)..(25)
  modified_base (1)..(1): base is a locked nucleic acid
  modified_base (10)..(10): base is a locked nucleic acid
  modified_base (13)..(13): base is a locked nucleic acid
  misc_feature (19)..(25): Adaptor region of the pan degenerate antisense primer that adapts the probe-binding site downstream of codon 100 to correspond to the nucleotides in an oligonucleotide probe downstream of the discriminating single nucleotide polymorphism.
actgtyactgayttkttctttttta

SEQ ID NO: 1950 - DNA, 25 bp, Artificial Sequence
  Pan degenerate oligonucleotide primer
  primer_bind (1)..(25)
  modified_base (1)..(1): base is a locked nucleic acid
  modified_base (7)..(7): base is a locked nucleic acid
  modified_base (10)..(10): base is a locked nucleic acid
  misc_feature (19)..(25): Adaptor region of the pan degenerate antisense primer that adapts the probe-binding site downstream of codon 100 to correspond to the nucleotides in an oligonucleotide probe downstream of the discriminating single nucleotide polymorphism.
actgtyactgayttkttctttttta

SEQ ID NO: 1951 - DNA, 40 bp, Artificial Sequence; identical to SEQ ID NO: 1922
  Pan degenerate oligonucleotide primer
  primer_bind (1)..(40)
  modified_base (1)..(1): base is a locked nucleic acid
  modified_base (9)..(9): base is a locked nucleic acid
  modified_base (12)..(12): base is a locked nucleic acid
  misc_feature (34)..(40): Adaptor region of the pan degenerate antisense primer that adapts the probe-binding site downstream of codon 100 to correspond to the nucleotides in an oligonucleotide probe downstream of the discriminating single nucleotide polymorphism.

SEQ ID NO: 1952 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 101 to correspond to the nucleotides in an oligonucleotide probe downstream of the discriminating single nucleotide polymorphism.
tcyaryactgtyactgayttkttctttt

SEQ ID NO: 1953 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 101 to correspond to the nucleotides in an oligonucleotide probe downstream of the discriminating single nucleotide polymorphism.
yacatcyaryactgtyactgayttkttctttt

SEQ ID NO: 1954 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 101 to correspond to the nucleotides in an oligonucleotide probe downstream of the discriminating single nucleotide polymorphism.
gcrtchccyacatcyaryactgtyactgayttkttctttt

SEQ ID NO: 1955 - DNA, 16 bp, Artificial Sequence
  Pan degenerate oligonucleotide primer
  primer_bind (1)..(16)
  misc_feature (10)..(16): Adaptor region of the pan degenerate antisense primer that adapts the probe-binding site downstream of codon 101 to correspond to the nucleotides in an oligonucleotide probe downstream of the discriminating single nucleotide polymorphism.
actgayttkttctttt

SEQ ID NO: 1956 - DNA, 19 bp, Artificial Sequence
  Pan degenerate oligonucleotide primer
  primer_bind (1)..(19)
  misc_feature (13)..(19): Adaptor region of the pan degenerate antisense primer that adapts the probe-binding site downstream of codon 101 to correspond to the nucleotides in an oligonucleotide probe downstream of the discriminating single nucleotide polymorphism.
gtyactgayttkttctttt

SEQ ID NO: 1957 - DNA, 22 bp, Artificial Sequence
  Pan degenerate oligonucleotide primer
  primer_bind (1)..(22)
  misc_feature (16)..(22): Adaptor region of the pan degenerate antisense primer that adapts the probe-binding site downstream of codon 101 to correspond to the nucleotides in an oligonucleotide probe downstream of the discriminating single nucleotide polymorphism.
actgtyactgayttkttctttt

SEQ ID NO: 1958 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 101 to correspond to the nucleotides in an oligonucleotide probe downstream of the discriminating single nucleotide polymorphism.
dactgaraartatgcatchccyacatcyarbactgtyacwgaytttttctt

SEQ ID NO: 1959 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 101 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tcyaryactgtyactgayttkttcttttn

SEQ ID NO: 1960 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 101 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
yacatcyaryactgtyactgayttkttcttttn

SEQ ID NO: 1961 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 101 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gcrtchccyacatcyaryactgtyactgayttkttcttttn

SEQ ID NO: 1962 - DNA, 17 bp, Artificial Sequence
  Pan degenerate oligonucleotide primer
  primer_bind (1)..(17)
  misc_feature (10)..(16): Adaptor region of the pan degenerate antisense primer that adapts the probe-binding site downstream of codon 101 to correspond to the nucleotides in an oligonucleotide probe downstream of the discriminating single nucleotide polymorphism.
  modified_base (17)..(17): base is a locked nucleic acid
  misc_feature (17)..(17): n is a, c, g, or t
actgayttkttcttttn

SEQ ID NO: 1963 - DNA, 20 bp, Artificial Sequence
  Pan degenerate oligonucleotide primer
  primer_bind (1)..(20)
  misc_feature (13)..(19): Adaptor region of the pan degenerate antisense primer that adapts the probe-binding site downstream of codon 101 to correspond to the nucleotides in an oligonucleotide probe downstream of the discriminating single nucleotide polymorphism.
  modified_base (20)..(20): base is a locked nucleic acid
  misc_feature (20)..(20): n is a, c, g, or t
gtyactgayttkttcttttn

SEQ ID NO: 1964 - DNA, 23 bp, Artificial Sequence
  Pan degenerate oligonucleotide primer
  primer_bind (1)..(23)
  misc_feature (16)..(22): Adaptor region of the pan degenerate antisense primer that adapts the probe-binding site downstream of codon 101 to correspond to the nucleotides in an oligonucleotide probe downstream of the discriminating single nucleotide polymorphism.
  modified_base (23)..(23): base is a locked nucleic acid
  misc_feature (23)..(23): n is a, c, g, or t
actgtyactgayttkttcttttn

SEQ ID NO: 1965 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 101 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
dactgaraartatgcatchccyacatcyarbactgtyacwgaytttttcttn

SEQ ID NO: 1966 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (13)..(13): base is a locked nucleic acid
  misc_feature (22)..(28): Adaptor region of the pan degenerate antisense primer that adapts the probe-binding site downstream of codon 101 to correspond to the nucleotides in an oligonucleotide probe downstream of the discriminating single nucleotide polymorphism.
tcyaryactgtyactgayttkttctttt

SEQ ID NO: 1967 - DNA, 28 bp, Artificial Sequence
  Pan degenerate oligonucleotide primer
  primer_bind (1)..(28)
  modified_base (1)..(1): base is a locked nucleic acid
  modified_base (10)..(10): base is a locked nucleic acid
  modified_base (13)..(13): base is a locked nucleic acid
  misc_feature (22)..(28): Adaptor region of the pan degenerate antisense primer that adapts the probe-binding site downstream of codon 101 to correspond to the nucleotides in an oligonucleotide probe downstream of the discriminating single nucleotide polymorphism.
tcyaryactgtyactgayttkttctttt

SEQ ID NO: 1968 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (10)..(10): base is a locked nucleic acid
  misc_feature (22)..(28): Adaptor region of the pan degenerate antisense primer that adapts the probe-binding site downstream of codon 101 to correspond to the nucleotides in an oligonucleotide probe downstream of the discriminating single nucleotide polymorphism.
tcyaryactgtyactgayttkttctttt

SEQ ID NO: 1969 - DNA, 32 bp, Artificial Sequence; identical to SEQ ID NO: 1953
  Pan degenerate oligonucleotide primer
  primer_bind (1)..(32)
  modified_base (1)..(1): base is a locked nucleic acid
  modified_base (5)..(5): base is a locked nucleic acid
  modified_base (14)..(14): base is a locked nucleic acid
  misc_feature (26)..(32): Adaptor region of the pan degenerate antisense primer that adapts the probe-binding site downstream of codon 101 to correspond to the nucleotides in an oligonucleotide probe downstream of the discriminating single nucleotide polymorphism.

SEQ ID NO: 1970 - DNA, 32 bp, Artificial Sequence; identical to SEQ ID NO: 1953
  Pan degenerate oligonucleotide primer
  primer_bind (1)..(32)
  modified_base (1)..(1): base is a locked nucleic acid
  modified_base (11)..(11): base is a locked nucleic acid
  modified_base (14)..(14): base is a locked nucleic acid
  misc_feature (26)..(32): Adaptor region of the pan degenerate antisense primer that adapts the probe-binding site downstream of codon 101 to correspond to the nucleotides in an oligonucleotide probe downstream of the discriminating single nucleotide polymorphism.

SEQ ID NO: 1971 - DNA, 32 bp, Artificial Sequence; identical to SEQ ID NO: 1953
  Pan degenerate oligonucleotide primer
  primer_bind (1)..(32)
  modified_base (1)..(1): base is a locked nucleic acid
  modified_base (5)..(5): base is a locked nucleic acid
  modified_base (11)..(11): base is a locked nucleic acid
  misc_feature (26)..(32): Adaptor region of the pan degenerate antisense primer that adapts the probe-binding site downstream of codon 101 to correspond to the nucleotides in an oligonucleotide probe downstream of the discriminating single nucleotide polymorphism.

SEQ ID NO: 1972 - DNA, 40 bp, Artificial Sequence; identical to SEQ ID NO: 1954
  Pan degenerate oligonucleotide primer
  primer_bind (1)..(40)
  modified_base (1)..(1): base is a locked nucleic acid
  modified_base (6)..(6): base is a locked nucleic acid
  modified_base (13)..(13): base is a locked nucleic acid
  misc_feature (34)..(40): Adaptor region of the pan degenerate antisense primer that adapts the probe-binding site downstream of codon 101 to correspond to the nucleotides in an oligonucleotide probe downstream of the discriminating single nucleotide polymorphism.

SEQ ID NO: 1973 - DNA, 16 bp, Artificial Sequence
  Pan degenerate oligonucleotide primer
  primer_bind (1)..(16)
  modified_base (1)..(1): base is a locked nucleic acid
  modified_base (3)..(3): base is a locked nucleic acid
  modified_base (7)..(7): base is a locked nucleic acid
  misc_feature (10)..(16): Adaptor region of the pan degenerate antisense primer that adapts the probe-binding site downstream of codon 101 to correspond to the nucleotides in an oligonucleotide probe downstream of the discriminating single nucleotide polymorphism.
actgayttkttctttt

SEQ ID NO: 1974 - DNA, 16 bp, Artificial Sequence
  Pan degenerate oligonucleotide primer
  primer_bind (1)..(16)
  modified_base (1)..(1): base is a locked nucleic acid
  modified_base (4)..(4): base is a locked nucleic acid
  modified_base (7)..(7): base is a locked nucleic acid
  misc_feature (10)..(16): Adaptor region of the pan degenerate antisense primer that adapts the probe-binding site downstream of codon 101 to correspond to the nucleotides in an oligonucleotide probe downstream of the discriminating single nucleotide polymorphism.
actgayttkttctttt

SEQ ID NO: 1975 - DNA, 16 bp, Artificial Sequence
  Pan degenerate oligonucleotide primer
  primer_bind (1)..(16)
  modified_base (1)..(1): base is a locked nucleic acid
  modified_base (3)..(3): base is a locked nucleic acid
  modified_base (4)..(4): base is a locked nucleic acid
  misc_feature (10)..(16): Adaptor region of the pan degenerate antisense primer that adapts the probe-binding site downstream of codon 101 to correspond to the nucleotides in an oligonucleotide probe downstream of the discriminating single nucleotide polymorphism.
actgayttkttctttt

SEQ ID NO: 1976 - DNA, 19 bp, Artificial Sequence
  Pan degenerate oligonucleotide primer
  primer_bind (1)..(19)
  modified_base (1)..(1): base is a locked nucleic acid
  modified_base (4)..(4): base is a locked nucleic acid
  modified_base (7)..(7): base is a locked nucleic acid
  misc_feature (13)..(19): Adaptor region of the pan degenerate antisense primer that adapts the probe-binding site downstream of codon 101 to correspond to the nucleotides in an oligonucleotide probe downstream of the discriminating single nucleotide polymorphism.
gtyactgayttkttctttt

SEQ ID NO: 1977 - DNA, 19 bp, Artificial Sequence
  Pan degenerate oligonucleotide primer
  primer_bind (1)..(19)
  modified_base (1)..(1): base is a locked nucleic acid
  modified_base (6)..(6): base is a locked nucleic acid
  modified_base (7)..(7): base is a locked nucleic acid
  misc_feature (13)..(19): Adaptor region of the pan degenerate antisense primer that adapts the probe-binding site downstream of codon 101 to correspond to the nucleotides in an oligonucleotide probe downstream of the discriminating single nucleotide polymorphism.
gtyactgayttkttctttt

SEQ ID NO: 1978 - DNA, 19 bp, Artificial Sequence
  Pan degenerate oligonucleotide primer
  primer_bind (1)..(19)
  modified_base (1)..(1): base is a locked nucleic acid
  modified_base (4)..(4): base is a locked nucleic acid
  modified_base (6)..(6): base is a locked nucleic acid
  misc_feature (13)..(19): Adaptor region of the pan degenerate antisense primer that adapts the probe-binding site downstream of codon 101 to correspond to the nucleotides in an oligonucleotide probe downstream of the discriminating single nucleotide polymorphism.
gtyactgayttkttctttt

SEQ ID NO: 1979 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (9)..(9): base is a locked nucleic acid
  misc_feature (16)..(22): Adaptor region of the pan degenerate antisense primer that adapts the probe-binding site downstream of codon 101 to correspond to the nucleotides in an oligonucleotide probe downstream of the discriminating single nucleotide polymorphism.
actgtyactgayttkttctttt

SEQ ID NO: 1980 - DNA, 22 bp, Artificial Sequence
  Pan degenerate oligonucleotide primer
  primer_bind (1)..(22)
  modified_base (1)..(1): base is a locked nucleic acid
  modified_base (7)..(7): base is a locked nucleic acid
  modified_base (9)..(9): base is a locked nucleic acid
  misc_feature (16)..(22): Adaptor region of the pan degenerate antisense primer that adapts the probe-binding site downstream of codon 101 to correspond to the nucleotides in an oligonucleotide probe downstream of the discriminating single nucleotide polymorphism.
actgtyactgayttkttctttt

SEQ ID NO: 1981 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (7)..(7): base is a locked nucleic acid
  misc_feature (16)..(22): Adaptor region of the pan degenerate antisense primer that adapts the probe-binding site downstream of codon 101 to correspond to the nucleotides in an oligonucleotide probe downstream of the discriminating single nucleotide polymorphism.
actgtyactgayttkttctttt

SEQ ID NO: 1982 - DNA, 40 bp, Artificial Sequence; identical to SEQ ID NO: 1954
  Pan degenerate oligonucleotide primer
  primer_bind (1)..(40)
  modified_base (6)..(6): base is a locked nucleic acid
  modified_base (9)..(9): base is a locked nucleic acid
  modified_base (13)..(13): base is a locked nucleic acid
  misc_feature (34)..(40): Adaptor region of the pan degenerate antisense primer that adapts the probe-binding site downstream of codon 101 to correspond to the nucleotides in an oligonucleotide probe downstream of the discriminating single nucleotide polymorphism.

SEQ ID NO: 1983 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 103 to correspond to the nucleotides in an oligonucleotide probe downstream of the discriminating single nucleotide polymorphism.
rtchccyacatcyaryactgtyactgaytt

SEQ ID NO: 1984 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 103 to correspond to the nucleotides in an oligonucleotide probe downstream of the discriminating single nucleotide polymorphism.
rtatgcrtchccyacatcyaryactgtyactgaytt

SEQ ID NO: 1985 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 103 to correspond to the nucleotides in an oligonucleotide probe downstream of the discriminating single nucleotide polymorphism.
araartatgcrtchccyacatcyaryactgtyactgaytt

SEQ ID NO: 1986 - DNA, 22 bp, Artificial Sequence
  Pan degenerate oligonucleotide primer
  primer_bind (1)..(22)
  misc_feature (16)..(22): Adaptor region of the pan degenerate antisense primer that adapts the probe-binding site downstream of codon 103 to correspond to the nucleotides in an oligonucleotide probe downstream of the discriminating single nucleotide polymorphism.
catcyaryactgtyactgaytt

SEQ ID NO: 1987 - DNA, 24 bp, Artificial Sequence
  Pan degenerate oligonucleotide primer
  primer_bind (1)..(24)
  misc_feature (18)..(24): Adaptor region of the pan degenerate antisense primer that adapts the probe-binding site downstream of codon 103 to correspond to the nucleotides in an oligonucleotide probe downstream of the discriminating single nucleotide polymorphism.
yacatcyaryactgtyactgaytt

SEQ ID NO: 1988 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 103 to correspond to the nucleotides in an oligonucleotide probe downstream of the discriminating single nucleotide polymorphism.
hccyacatcyaryactgtyactgaytt

SEQ ID NO: 1989 - DNA, 52 bp, Artificial Sequence
  Pan degenerate oligonucleotide primer
  primer_bind (1)..(52)
  misc_feature (46)..(52): Adaptor region of the pan degenerate antisense primer that adapts the probe-binding site downstream of codon 103 to correspond to the nucleotides in an oligonucleotide probe downstream of the discriminating single nucleotide polymorphism.
mtaarggdactgaraartatgcatchccyacatcyarbactgtyactgattt

SEQ ID NO: 1990 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 103 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
rtchccyacatcyaryactgtyactgayttn

SEQ ID NO: 1991 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 103 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
rtatgcrtchccyacatcyaryactgtyactgayttn

SEQ ID NO: 1992 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 103 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
araartatgcrtchccyacatcyaryactgtyactgayttn

SEQ ID NO: 1993 - DNA, 23 bp, Artificial Sequence
  Pan degenerate oligonucleotide primer
  primer_bind (1)..(23)
  misc_feature (16)..(22): Adaptor region of the pan degenerate antisense primer that adapts the probe-binding site downstream of codon 103 to correspond to the nucleotides in an oligonucleotide probe downstream of the discriminating single nucleotide polymorphism.
  modified_base (23)..(23): base is a locked nucleic acid
  misc_feature (23)..(23): n is a, c, g, or t
catcyaryactgtyactgayttn

SEQ ID NO: 1994 - DNA, 25 bp, Artificial Sequence
  Pan degenerate oligonucleotide primer
  primer_bind (1)..(25)
  misc_feature (18)..(24): Adaptor region of the pan degenerate antisense primer that adapts the probe-binding site downstream of codon 103 to correspond to the nucleotides in an oligonucleotide probe downstream of the discriminating single nucleotide polymorphism.
  modified_base (25)..(25): base is a locked nucleic acid
  misc_feature (25)..(25): n is a, c, g, or t
yacatcyaryactgtyactgayttn

SEQ ID NO: 1995 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 103 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
hccyacatcyaryactgtyactgayttn

SEQ ID NO: 1996 - DNA, 53 bp, Artificial Sequence
  Pan degenerate oligonucleotide primer
  primer_bind (1)..(53)
  misc_feature (46)..(52): Adaptor region of the pan degenerate antisense primer that adapts the probe-binding site downstream of codon 103 to correspond to the nucleotides in an oligonucleotide probe downstream of the discriminating single nucleotide polymorphism.
  modified_base (53)..(53): base is a locked nucleic acid
  misc_feature (53)..(53): n is a, c, g, or t
mtaarggdactgaraartatgcatchccyacatcyarbactgtyactgatttn

SEQ ID NO: 1997 - DNA, 30 bp, Artificial Sequence; identical to SEQ ID NO: 1983
  Pan degenerate oligonucleotide primer
  primer_bind (1)..(30)
  modified_base (1)..(1): base is a locked nucleic acid
  modified_base (4)..(4): base is a locked nucleic acid
  modified_base (9)..(9): base is a locked nucleic acid
  misc_feature (24)..(30): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 1998 - DNA, 30 bp, Artificial Sequence; identical to SEQ ID NO: 1983
  Pan degenerate oligonucleotide primer
  primer_bind (1)..(30)
  modified_base (1)..(1): base is a locked nucleic acid
  modified_base (7)..(7): base is a locked nucleic acid
  modified_base (9)..(9): base is a locked nucleic acid
  misc_feature (24)..(30): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 1999 - DNA, 30 bp, Artificial Sequence; identical to SEQ ID NO: 1983
  Pan degenerate oligonucleotide primer
  primer_bind (1)..(30)
  modified_base (1)..(1): base is a locked nucleic acid
  modified_base (4)..(4): base is a locked nucleic acid
  modified_base (7)..(7): base is a locked nucleic acid
  misc_feature (24)..(30): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 2000 - DNA, 36 bp, Artificial Sequence; identical to SEQ ID NO: 1984
  Pan degenerate oligonucleotide primer
  primer_bind (1)..(36)
  modified_base (1)..(1): base is a locked nucleic acid
  modified_base (7)..(7): base is a locked nucleic acid
  modified_base (13)..(13): base is a locked nucleic acid
  misc_feature (30)..(36): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 2001 - DNA, 36 bp, Artificial Sequence; identical to SEQ ID NO: 1984
  Pan degenerate oligonucleotide primer
  primer_bind (1)..(36)
  modified_base (1)..(1): base is a locked nucleic acid
  modified_base (10)..(10): base is a locked nucleic acid
  modified_base (13)..(13): base is a locked nucleic acid
  misc_feature (30)..(36): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 2002 - DNA, 36 bp, Artificial Sequence; identical to SEQ ID NO: 1984
  Pan degenerate oligonucleotide primer
  primer_bind (1)..(36)
  modified_base (1)..(1): base is a locked nucleic acid
  modified_base (7)..(7): base is a locked nucleic acid
  modified_base (10)..(10): base is a locked nucleic acid
  misc_feature (30)..(36): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 2003 - DNA, 40 bp, Artificial Sequence; identical to SEQ ID NO: 1985
  Pan degenerate oligonucleotide primer
  primer_bind (1)..(40)
  modified_base (1)..(1): base is a locked nucleic acid
  modified_base (5)..(5): base is a locked nucleic acid
  modified_base (14)..(14): base is a locked nucleic acid
  misc_feature (34)..(40): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 2004 - DNA, 40 bp, Artificial Sequence; identical to SEQ ID NO: 1985
  Pan degenerate oligonucleotide primer
  primer_bind (1)..(40)
  modified_base (1)..(1): base is a locked nucleic acid
  modified_base (11)..(11): base is a locked nucleic acid
  modified_base (14)..(14): base is a locked nucleic acid
  misc_feature (34)..(40): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 2005 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (7)..(7): base is a locked nucleic acid
  misc_feature (16)..(22): Adaptor region of the pan degenerate antisense primer that adapts the probe-binding site downstream of codon 103 to correspond to the nucleotides in an oligonucleotide probe downstream of the discriminating single nucleotide polymorphism.
catcyaryactgtyactgaytt

SEQ ID NO: 2006 - DNA, 22 bp, Artificial Sequence
  Pan degenerate oligonucleotide primer
  primer_bind (1)..(22)
  modified_base (1)..(1): base is a locked nucleic acid
  modified_base (5)..(5): base is a locked nucleic acid
  modified_base (7)..(7): base is a locked nucleic acid
  misc_feature (16)..(22): Adaptor region of the pan degenerate antisense primer that adapts the probe-binding site downstream of codon 103 to correspond to the nucleotides in an oligonucleotide probe downstream of the discriminating single nucleotide polymorphism.
catcyaryactgtyactgaytt

SEQ ID NO: 2007 - DNA, 22 bp, Artificial Sequence
  Pan degenerate oligonucleotide primer
  primer_bind (1)..(22)
  modified_base (1)..(1): base is a locked nucleic acid
  modified_base (2)..(2): base is a locked nucleic acid
  modified_base (5)..(5): base is a locked nucleic acid
  misc_feature (16)..(22): Adaptor region of the pan degenerate antisense primer that adapts the probe-binding site downstream of codon 103 to correspond to the nucleotides in an oligonucleotide probe downstream of the discriminating single nucleotide polymorphism.
catcyaryactgtyactgaytt

SEQ ID NO: 2008 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (7)..(7): base is a locked nucleic acid
  misc_feature (18)..(24): Adaptor region of the pan degenerate antisense primer that adapts the probe-binding site downstream of codon 103 to correspond to the nucleotides in an oligonucleotide probe downstream of the discriminating single nucleotide polymorphism.
yacatcyaryactgtyactgaytt

SEQ ID NO: 2009 - DNA, 24 bp, Artificial Sequence
  Pan degenerate oligonucleotide primer
  primer_bind (1)..(24)
  modified_base (1)..(1): base is a locked nucleic acid
  modified_base (4)..(4): base is a locked nucleic acid
  modified_base (7)..(7): base is a locked nucleic acid
  misc_feature (18)..(24): Adaptor region of the pan degenerate antisense primer that adapts the probe-binding site downstream of codon 103 to correspond to the nucleotides in an oligonucleotide probe downstream of the discriminating single nucleotide polymorphism.
yacatcyaryactgtyactgaytt

SEQ ID NO: 2010 - DNA, 24 bp, Artificial Sequence
  Pan degenerate oligonucleotide primer
  primer_bind (1)..(24)
  modified_base (1)..(1): base is a locked nucleic acid
  modified_base (3)..(3): base is a locked nucleic acid
  modified_base (4)..(4): base is a locked nucleic acid
  misc_feature (18)..(24): Adaptor region of the pan degenerate antisense primer that adapts the probe-binding site downstream of codon 103 to correspond to the nucleotides in an oligonucleotide probe downstream of the discriminating single nucleotide polymorphism.
yacatcyaryactgtyactgaytt

SEQ ID NO: 2011 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (7)..(7): base is a locked nucleic acid
  misc_feature (21)..(27): Adaptor region of the pan degenerate antisense primer that adapts the probe-binding site downstream of codon 103 to correspond to the nucleotides in an oligonucleotide probe downstream of the discriminating single nucleotide polymorphism.
hccyacatcyaryactgtyactgaytt

SEQ ID NO: 2012 - DNA, 27 bp, Artificial Sequence
  Pan degenerate oligonucleotide primer
  primer_bind (1)..(27)
  modified_base (1)..(1): base is a locked nucleic acid
  modified_base (6)..(6): base is a locked nucleic acid
  modified_base (7)..(7): base is a locked nucleic acid
  misc_feature (21)..(27): Adaptor region of the pan degenerate antisense primer that adapts the probe-binding site downstream of codon 103 to correspond to the nucleotides in an oligonucleotide probe downstream of the discriminating single nucleotide polymorphism.
hccyacatcyaryactgtyactgaytt

SEQ ID NO: 2013 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (6)..(6): base is a locked nucleic acid
  misc_feature (21)..(27): Adaptor region of the pan degenerate antisense primer that adapts the probe-binding site downstream of codon 103 to correspond to the nucleotides in an oligonucleotide probe downstream of the discriminating single nucleotide polymorphism.
hccyacatcyaryactgtyactgaytt

SEQ ID NO: 2014 - DNA, 40 bp, Artificial Sequence; identical to SEQ ID NO: 1985
  Pan degenerate oligonucleotide primer
  primer_bind (1)..(40)
  modified_base (1)..(1): base is a locked nucleic acid
  modified_base (5)..(5): base is a locked nucleic acid
  modified_base (11)..(11): base is a locked nucleic acid
  misc_feature (34)..(40): Adaptor region of the pan degenerate antisense primer that adapts the probe-binding site downstream of codon 103 to correspond to the nucleotides in an oligonucleotide probe downstream of the discriminating single nucleotide polymorphism.

SEQ ID NO: 2015 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 106 to correspond to the nucleotides in an oligonucleotide probe downstream of the discriminating single nucleotide polymorphism.
araartatgcrtchccyacatcyaryactgty

SEQ ID NO: 2016 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 106 to correspond to the nucleotides in an oligonucleotide probe downstream of the discriminating single nucleotide polymorphism.
ctgaraartatgcrtchccyacatcyaryactgty

SEQ ID NO: 2017 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 106 to correspond to the nucleotides in an oligonucleotide probe downstream of the discriminating single nucleotide polymorphism.
rggractgaraartatgcrtchccyacatcyaryactgty

SEQ ID NO: 2018 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 106 to correspond to the nucleotides in an oligonucleotide probe downstream of the discriminating single nucleotide polymorphism.
atgcrtchccyacatcyaryactgty

SEQ ID NO: 2019 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 106 to correspond to the nucleotides in an oligonucleotide probe downstream of the discriminating single nucleotide polymorphism.
artatgcrtchccyacatcyaryactgty

SEQ ID NO: 2020 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 106 to correspond to the nucleotides in an oligonucleotide probe downstream of the discriminating single nucleotide polymorphism.
aartatgcrtchccyacatcyaryactgty

SEQ ID NO: 2021 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 106 to correspond to the nucleotides in an oligonucleotide probe downstream of the discriminating single nucleotide polymorphism.
dyyytyatmtaarggdactgaraartatgcatchccyacatcyartactgt

SEQ ID NO: 2022 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 106 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
araartatgcrtchccyacatcyaryactgtyn

SEQ ID NO: 2023 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 106 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ctgaraartatgcrtchccyacatcyaryactgtyn

SEQ ID NO: 2024 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 106 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
rggractgaraartatgcrtchccyacatcyaryactgtyn

SEQ ID NO: 2025 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 106 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
atgcrtchccyacatcyaryactgtyn

SEQ ID NO: 2026 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 106 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
artatgcrtchccyacatcyaryactgtyn

SEQ ID NO: 2027 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 106 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
aartatgcrtchccyacatcyaryactgtyn

SEQ ID NO: 2028 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 106 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
dyyytyatmtaarggdactgaraartatgcatchccyacatcyartactgtn

SEQ ID NO: 2029 - DNA, 32 bp, Artificial Sequence; identical to SEQ ID NO: 2015
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (26)..(32): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2030 - DNA, 32 bp, Artificial Sequence; identical to SEQ ID NO: 2015
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2031 - DNA, 32 bp, Artificial Sequence; identical to SEQ ID NO: 2015
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2032 - DNA, 35 bp, Artificial Sequence; identical to SEQ ID NO: 2016
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2033 - DNA, 35 bp, Artificial Sequence; identical to SEQ ID NO: 2016
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2034 - DNA, 35 bp, Artificial Sequence; identical to SEQ ID NO: 2016
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2035 - DNA, 40 bp, Artificial Sequence; identical to SEQ ID NO: 2017
  Pan degenerate oligonucleotide primer
  primer_bind (1)..(40)
  modified_base (3)..(3): base is a locked nucleic acid
  modified_base (6)..(6): base is a locked nucleic acid
  modified_base (11)..(11): base is a locked nucleic acid
  misc_feature (34)..(40): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2036 - DNA, 40 bp, Artificial Sequence; identical to SEQ ID NO: 2017
  Pan degenerate oligonucleotide primer
  primer_bind (1)..(40)
  modified_base (3)..(3): base is a locked nucleic acid
  modified_base (9)..(9): base is a locked nucleic acid
  modified_base (11)..(11): base is a locked nucleic acid
  misc_feature (34)..(40): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2037 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (6)..(6): base is a locked nucleic acid
  misc_feature (20)..(26): Adaptor region of the pan degenerate antisense primer that adapts the probe-binding site downstream of codon 106 to correspond to the nucleotides in an oligonucleotide probe downstream of the discriminating single nucleotide polymorphism.
atgcrtchccyacatcyaryactgty

SEQ ID NO: 2038 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (6)..(6): base is a locked nucleic acid
  misc_feature (20)..(26): Adaptor region of the pan degenerate antisense primer that adapts the probe-binding site downstream of codon 106 to correspond to the nucleotides in an oligonucleotide probe downstream of the discriminating single nucleotide polymorphism.
atgcrtchccyacatcyaryactgty

SEQ ID NO: 2039 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate antisense primer that adapts the probe-binding site downstream of codon 106 to correspond to the nucleotides in an oligonucleotide probe downstream of the discriminating single nucleotide polymorphism.
atgcrtchccyacatcyaryactgty

SEQ ID NO: 2040 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate antisense primer that adapts the probe-binding site downstream of codon 106 to correspond to the nucleotides in an oligonucleotide probe downstream of the discriminating single nucleotide polymorphism.
artatgcrtchccyacatcyaryactgty

SEQ ID NO: 2041 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate antisense primer that adapts the probe-binding site downstream of codon 106 to correspond to the nucleotides in an oligonucleotide probe downstream of the discriminating single nucleotide polymorphism.
artatgcrtchccyacatcyaryactgty

SEQ ID NO: 2042 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate antisense primer that adapts the probe-binding site downstream of codon 106 to correspond to the nucleotides in an oligonucleotide probe downstream of the discriminating single nucleotide polymorphism.
artatgcrtchccyacatcyaryactgty

SEQ ID NO: 2043 - DNA, 30 bp, Artificial Sequence; identical to SEQ ID NO: 2020
  Pan degenerate oligonucleotide primer
  primer_bind (1)..(30)
  modified_base (1)..(1): base is a locked nucleic acid
  modified_base (2)..(2): base is a locked nucleic acid
  modified_base (7)..(7): base is a locked nucleic acid
  misc_feature (24)..(30): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2044 - DNA, 30 bp, Artificial Sequence; identical to SEQ ID NO: 2020
  Pan degenerate oligonucleotide primer
  primer_bind (1)..(30)
  modified_base (1)..(1): base is a locked nucleic acid
  modified_base (5)..(5): base is a locked nucleic acid
  modified_base (7)..(7): base is a locked nucleic acid
  misc_feature (24)..(30): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2045 - DNA, 30 bp, Artificial Sequence; identical to SEQ ID NO: 2020
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2046 - DNA, 40 bp, Artificial Sequence; identical to SEQ ID NO: 2017
  Pan degenerate oligonucleotide primer
  primer_bind (1)..(40)
  modified_base (3)..(3): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 106 to correspond to the nucleotides in an oligonucleotide probe downstream of the discriminating single nucleotide polymorphism.

SEQ ID NO: 2047 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 108 to correspond to the nucleotides in an oligonucleotide probe downstream of the discriminating single nucleotide polymorphism.
rggractgaraartatgcrtchccyacatcyarya

SEQ ID NO: 2048 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 108 to correspond to the nucleotides in an oligonucleotide probe downstream of the discriminating single nucleotide polymorphism.
aarggractgaraartatgcrtchccyacatcyarya

SEQ ID NO: 2049 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 108 to correspond to the nucleotides in an oligonucleotide probe downstream of the discriminating single nucleotide polymorphism.
tvtaarggractgaraartatgcrtchccyacatcyarya

SEQ ID NO: 2050 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 108 to correspond to the nucleotides in an oligonucleotide probe downstream of the discriminating single nucleotide polymorphism.
tgaraartatgcrtchccyacatcyarya

SEQ ID NO: 2051 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 108 to correspond to the nucleotides in an oligonucleotide probe downstream of the discriminating single nucleotide polymorphism.
actgaraartatgcrtchccyacatcyarya

SEQ ID NO: 2052 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 108 to correspond to the nucleotides in an oligonucleotide probe downstream of the discriminating single nucleotide polymorphism.
ggractgaraartatgcrtchccyacatcyarya

SEQ ID NO: 2053 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 108 to correspond to the nucleotides in an oligonucleotide probe downstream of the discriminating single nucleotide polymorphism.
yctraadyyytyatmtaarggdactgaraartatgcatchccyacatccag

SEQ ID NO: 2054 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 108 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
rggractgaraartatgcrtchccyacatcyaryan

SEQ ID NO: 2055 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 108 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
aarggractgaraartatgcrtchccyacatcyaryan

SEQ ID NO: 2056 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 108 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tvtaarggractgaraartatgcrtchccyacatcyaryan

SEQ ID NO: 2057 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 108 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
tgaraartatgcrtchccyacatcyaryan

SEQ ID NO: 2058 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 108 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
actgaraartatgcrtchccyacatcyaryan

SEQ ID NO: 2059 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 108 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ggractgaraartatgcrtchccyacatcyaryan

SEQ ID NO: 2060 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 108 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
yctraadyyytyatmtaarggdactgaraartatgcatchccyacatccagn

SEQ ID NO: 2061 - DNA, 35 bp, Artificial Sequence; identical to SEQ ID NO: 2047
  Pan degenerate oligonucleotide primer
  primer_bind (1)..(35)
  modified_base (1)..(1): base is a locked nucleic acid
  modified_base (2)..(2): base is a locked nucleic acid
  modified_base (7)..(7): base is a locked nucleic acid
  misc_feature (29)..(35): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2062 - DNA, 35 bp, Artificial Sequence; identical to SEQ ID NO: 2047
  Pan degenerate oligonucleotide primer
  primer_bind (1)..(35)
  modified_base (1)..(1): base is a locked nucleic acid
  modified_base (5)..(5): base is a locked nucleic acid
  modified_base (7)..(7): base is a locked nucleic acid
  misc_feature (29)..(35): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2063 - DNA, 35 bp, Artificial Sequence; identical to SEQ ID NO: 2047
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2064 - DNA, 37 bp, Artificial Sequence; identical to SEQ ID NO: 2048
  Pan degenerate oligonucleotide primer
  primer_bind (1)..(37)
  modified_base (1)..(1): base is a locked nucleic acid
  modified_base (3)..(3): base is a locked nucleic acid
  modified_base (7)..(7): base is a locked nucleic acid
  misc_feature (31)..(37): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2065 - DNA, 37 bp, Artificial Sequence; identical to SEQ ID NO: 2048
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2066 - DNA, 37 bp, Artificial Sequence; identical to SEQ ID NO: 2048
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2067 - DNA, 40 bp, Artificial Sequence; identical to SEQ ID NO: 2049
  Pan degenerate oligonucleotide primer
  primer_bind (1)..(40)
  modified_base (4)..(4): base is a locked nucleic acid
  modified_base (6)..(6): base is a locked nucleic acid
  modified_base (10)..(10): base is a locked nucleic acid
  misc_feature (34)..(40): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2068 - DNA, 40 bp, Artificial Sequence; identical to SEQ ID NO: 2049
  Pan degenerate oligonucleotide primer
  primer_bind (1)..(40)
  modified_base (6)..(6): base is a locked nucleic acid
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2069 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 108 to correspond to the nucleotides in an oligonucleotide probe downstream of the discriminating single nucleotide polymorphism.
tgaraartatgcrtchccyacatcyarya

SEQ ID NO: 2070 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 108 to correspond to the nucleotides in an oligonucleotide probe downstream of the discriminating single nucleotide polymorphism.
tgaraartatgcrtchccyacatcyarya

SEQ ID NO: 2071 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 108 to correspond to the nucleotides in an oligonucleotide probe downstream of the discriminating single nucleotide polymorphism.
tgaraartatgcrtchccyacatcyarya

SEQ ID NO: 2072 - DNA, 31 bp, Artificial Sequence; identical to SEQ ID NO: 2051
  Pan degenerate oligonucleotide primer
  primer_bind (1)..(31)
  modified_base (1)..(1): base is a locked nucleic acid
  modified_base (3)..(3): base is a locked nucleic acid
  modified_base (6)..(6): base is a locked nucleic acid
  misc_feature (25)..(31): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2073 - DNA, 31 bp, Artificial Sequence; identical to SEQ ID NO: 2051
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2074 - DNA, 31 bp, Artificial Sequence; identical to SEQ ID NO: 2051
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2075 - DNA, 34 bp, Artificial Sequence; identical to SEQ ID NO: 2052
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2076 - DNA, 34 bp, Artificial Sequence; identical to SEQ ID NO: 2052
  Pan degenerate oligonucleotide primer
  primer_bind (1)..(34)
  modified_base (1)..(1): base is a locked nucleic acid
  modified_base (6)..(6): base is a locked nucleic acid
  modified_base (7)..(7): base is a locked nucleic acid
  misc_feature (28)..(34): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2077 - DNA, 34 bp, Artificial Sequence; identical to SEQ ID NO: 2052
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2078 - DNA, 40 bp, Artificial Sequence; identical to SEQ ID NO: 2049
  Pan degenerate oligonucleotide primer
  primer_bind (1)..(40)
  modified_base (1)..(1): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 108 to correspond to the nucleotides in an oligonucleotide probe downstream of the discriminating single nucleotide polymorphism.

SEQ ID NO: 2079 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 115 to correspond to the nucleotides in an oligonucleotide probe downstream of the discriminating single nucleotide polymorphism.
ayttyctraadyyytyatvtaarggractgaraar

SEQ ID NO: 2080 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 115 to correspond to the nucleotides in an oligonucleotide probe downstream of the discriminating single nucleotide polymorphism.
tayttyctraadyyytyatvtaarggractgaraar

SEQ ID NO: 2081 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 115 to correspond to the nucleotides in an oligonucleotide probe downstream of the discriminating single nucleotide polymorphism.
agtrtayttyctraadyyytyatvtaarggractgaraar

SEQ ID NO: 2082 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 115 to correspond to the nucleotides in an oligonucleotide probe downstream of the discriminating single nucleotide polymorphism.
traadyyytyatvtaarggractgaraar

SEQ ID NO: 2083 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 115 to correspond to the nucleotides in an oligonucleotide probe downstream of the discriminating single nucleotide polymorphism.
ctraadyyytyatvtaarggractgaraar

SEQ ID NO: 2084 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 115 to correspond to the nucleotides in an oligonucleotide probe downstream of the discriminating single nucleotide polymorphism.
tyctraadyyytyatvtaarggractgaraar

SEQ ID NO: 2085 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 115 to correspond to the nucleotides in an oligonucleotide probe downstream of the discriminating single nucleotide polymorphism.
tatrgtraatgcagtrtayttyctraadyyytyatmtaarggdactgaaaa

SEQ ID NO: 2086 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 115 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ayttyctraadyyytyatvtaarggractgaraarn

SEQ ID NO: 2087 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 115 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
tayttyctraadyyytyatvtaarggractgaraarn

SEQ ID NO: 2088 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 115 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
agtrtayttyctraadyyytyatvtaarggractgaraarn

SEQ ID NO: 2089 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 115 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
traadyyytyatvtaarggractgaraarn

SEQ ID NO: 2090 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 115 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
ctraadyyytyatvtaarggractgaraarn

SEQ ID NO: 2091 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 115 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tyctraadyyytyatvtaarggractgaraarn

SEQ ID NO: 2092 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 115 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tatrgtraatgcagtrtayttyctraadyyytyatmtaarggdactgaaaan

SEQ ID NO: 2093 - DNA, 35 bp, Artificial Sequence; identical to SEQ ID NO: 2079
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2094 - DNA, 35 bp, Artificial Sequence; identical to SEQ ID NO: 2079
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2095 - DNA, 35 bp, Artificial Sequence; identical to SEQ ID NO: 2079
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2096 - DNA, 36 bp, Artificial Sequence; identical to SEQ ID NO: 2080
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (30)..(36): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2097 - DNA, 36 bp, Artificial Sequence; identical to SEQ ID NO: 2080
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (30)..(36): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2098 - DNA, 36 bp, Artificial Sequence; identical to SEQ ID NO: 2080
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2099 - DNA, 40 bp, Artificial Sequence; identical to SEQ ID NO: 2081
  Pan degenerate oligonucleotide primer
  primer_bind (1)..(40)
  modified_base (2)..(2): base is a locked nucleic acid
  modified_base (5)..(5): base is a locked nucleic acid
  modified_base (9)..(9): base is a locked nucleic acid
  misc_feature (34)..(40): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2100 - DNA, 40 bp, Artificial Sequence; identical to SEQ ID NO: 2081
  Pan degenerate oligonucleotide primer
  primer_bind (1)..(40)
  modified_base (2)..(2): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2101 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (16)..(16): base is a locked nucleic acid
  misc_feature (23)..(29): Adaptor region of the pan degenerate antisense primer that adapts the probe-binding site downstream of codon 115 to correspond to the nucleotides in an oligonucleotide probe downstream of the discriminating single nucleotide polymorphism.
traadyyytyatvtaarggractgaraar

SEQ ID NO: 2102 - DNA, 29 bp, Artificial Sequence
  Pan degenerate oligonucleotide primer
  primer_bind (1)..(29)
  modified_base (1)..(1): base is a locked nucleic acid
  modified_base (15)..(15): base is a locked nucleic acid
  modified_base (16)..(16): base is a locked nucleic acid
  misc_feature (23)..(29): Adaptor region of the pan degenerate antisense primer that adapts the probe-binding site downstream of codon 115 to correspond to the nucleotides in an oligonucleotide probe downstream of the discriminating single nucleotide polymorphism.
traadyyytyatvtaarggractgaraar

SEQ ID NO: 2103 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (15)..(15): base is a locked nucleic acid
  misc_feature (23)..(29): Adaptor region of the pan degenerate antisense primer that adapts the probe-binding site downstream of codon 115 to correspond to the nucleotides in an oligonucleotide probe downstream of the discriminating single nucleotide polymorphism.
traadyyytyatvtaarggractgaraar

SEQ ID NO: 2104 - DNA, 30 bp, Artificial Sequence; identical to SEQ ID NO: 2083
  Pan degenerate oligonucleotide primer
  primer_bind (1)..(30)
  modified_base (1)..(1): base is a locked nucleic acid
  modified_base (2)..(2): base is a locked nucleic acid
  modified_base (16)..(16): base is a locked nucleic acid
  misc_feature (24)..(30): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2105 - DNA, 30 bp, Artificial Sequence; identical to SEQ ID NO: 2083
  Pan degenerate oligonucleotide primer
  primer_bind (1)..(30)
  modified_base (1)..(1): base is a locked nucleic acid
  modified_base (5)..(5): base is a locked nucleic acid
  modified_base (16)..(16): base is a locked nucleic acid
  misc_feature (24)..(30): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2106 - DNA, 30 bp, Artificial Sequence; identical to SEQ ID NO: 2083
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2107 - DNA, 32 bp, Artificial Sequence; identical to SEQ ID NO: 2084
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (26)..(32): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2108 - DNA, 32 bp, Artificial Sequence; identical to SEQ ID NO: 2084
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2109 - DNA, 32 bp, Artificial Sequence; identical to SEQ ID NO: 2084
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2110 - DNA, 40 bp, Artificial Sequence; identical to SEQ ID NO: 2081
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 115 to correspond to the nucleotides in an oligonucleotide probe downstream of the discriminating single nucleotide polymorphism.

SEQ ID NO: 2111 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 116 to correspond to the nucleotides in an oligonucleotide probe downstream of the discriminating single nucleotide polymorphism.
trtayttyctraadyyytyatvtaarggractgar

SEQ ID NO: 2112 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 116 to correspond to the nucleotides in an oligonucleotide probe downstream of the discriminating single nucleotide polymorphism.
cagtrtayttyctraadyyytyatvtaarggractgar

SEQ ID NO: 2113 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 116 to correspond to the nucleotides in an oligonucleotide probe downstream of the discriminating single nucleotide polymorphism.
tgcagtrtayttyctraadyyytyatvtaarggractgar

SEQ ID NO: 2114 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 116 to correspond to the nucleotides in an oligonucleotide probe downstream of the discriminating single nucleotide polymorphism.
tyctraadyyytyatvtaarggractgar

SEQ ID NO: 2115 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 116 to correspond to the nucleotides in an oligonucleotide probe downstream of the discriminating single nucleotide polymorphism.
ayttyctraadyyytyatvtaarggractgar

SEQ ID NO: 2116 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 116 to correspond to the nucleotides in an oligonucleotide probe downstream of the discriminating single nucleotide polymorphism.
tayttyctraadyyytyatvtaarggractgar

SEQ ID NO: 2117 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 116 to correspond to the nucleotides in an oligonucleotide probe downstream of the discriminating single nucleotide polymorphism.
rggtatrgtraatgcagtrtayttyctraadyyytyatmtaarggaactga

SEQ ID NO: 2118 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 116 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
trtayttyctraadyyytyatvtaarggractgarn

SEQ ID NO: 2119 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 116 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
cagtrtayttyctraadyyytyatvtaarggractgarn

SEQ ID NO: 2120 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 116 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tgcagtrtayttyctraadyyytyatvtaarggractgarn

SEQ ID NO: 2121 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 116 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
tyctraadyyytyatvtaarggractgarn

SEQ ID NO: 2122 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 116 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ayttyctraadyyytyatvtaarggractgarn

SEQ ID NO: 2123 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 116 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tayttyctraadyyytyatvtaarggractgarn

SEQ ID NO: 2124 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 116 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
rggtatrgtraatgcagtrtayttyctraadyyytyatmtaarggaactgan

SEQ ID NO: 2125 - DNA, 35 bp, Artificial Sequence; identical to SEQ ID NO: 2111
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2126 - DNA, 35 bp, Artificial Sequence; identical to SEQ ID NO: 2111
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2127 - DNA, 35 bp, Artificial Sequence; identical to SEQ ID NO: 2111
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2128 - DNA, 38 bp, Artificial Sequence; identical to SEQ ID NO: 2112
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2129 - DNA, 38 bp, Artificial Sequence; identical to SEQ ID NO: 2112
  Pan degenerate oligonucleotide primer
  primer_bind (1)..(38)
  modified_base (1)..(1): base is a locked nucleic acid
  modified_base (6)..(6): base is a locked nucleic acid
  modified_base (7)..(7): base is a locked nucleic acid
  misc_feature (32)..(38): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2130 - DNA, 38 bp, Artificial Sequence; identical to SEQ ID NO: 2112
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2131 - DNA, 40 bp, Artificial Sequence; identical to SEQ ID NO: 2113
  Pan degenerate oligonucleotide primer
  primer_bind (1)..(40)
  modified_base (2)..(2): base is a locked nucleic acid
  modified_base (3)..(3): base is a locked nucleic acid
  modified_base (8)..(8): base is a locked nucleic acid
  misc_feature (34)..(40): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2132 - DNA, 40 bp, Artificial Sequence; identical to SEQ ID NO: 2113
  Pan degenerate oligonucleotide primer
  primer_bind (1)..(40)
  modified_base (2)..(2): base is a locked nucleic acid
  modified_base (6)..(6): base is a locked nucleic acid
  modified_base (8)..(8): base is a locked nucleic acid
  misc_feature (34)..(40): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2133 - DNA, 29 bp, Artificial Sequence
  Pan degenerate oligonucleotide primer
  primer_bind (1)..(29)
  modified_base (1)..(1): base is a locked nucleic acid
  modified_base (12)..(12): base is a locked nucleic acid
  modified_base (15)..(15): base is a locked nucleic acid
  misc_feature (23)..(29): Adaptor region of the pan degenerate antisense primer that adapts the probe-binding site downstream of codon 116 to correspond to the nucleotides in an oligonucleotide probe downstream of the discriminating single nucleotide polymorphism.
tyctraadyyytyatvtaarggractgar

SEQ ID NO: 2134 - DNA, 29 bp, Artificial Sequence
  Pan degenerate oligonucleotide primer
  primer_bind (1)..(29)
  modified_base (1)..(1): base is a locked nucleic acid
  modified_base (13)..(13): base is a locked nucleic acid
  modified_base (15)..(15): base is a locked nucleic acid
  misc_feature (23)..(29): Adaptor region of the pan degenerate antisense primer that adapts the probe-binding site downstream of codon 116 to correspond to the nucleotides in an oligonucleotide probe downstream of the discriminating single nucleotide polymorphism.
tyctraadyyytyatvtaarggractgar

SEQ ID NO: 2135 - DNA, 29 bp, Artificial Sequence
  Pan degenerate oligonucleotide primer
  primer_bind (1)..(29)
  modified_base (1)..(1): base is a locked nucleic acid
  modified_base (12)..(12): base is a locked nucleic acid
  modified_base (13)..(13): base is a locked nucleic acid
  misc_feature (23)..(29): Adaptor region of the pan degenerate antisense primer that adapts the probe-binding site downstream of codon 116 to correspond to the nucleotides in an oligonucleotide probe downstream of the discriminating single nucleotide polymorphism.
tyctraadyyytyatvtaarggractgar

SEQ ID NO: 2136 - DNA, 32 bp, Artificial Sequence; identical to SEQ ID NO: 2115
  Pan degenerate oligonucleotide primer
  primer_bind (1)..(32)
  modified_base (1)..(1): base is a locked nucleic acid
  modified_base (4)..(4): base is a locked nucleic acid
  modified_base (16)..(16): base is a locked nucleic acid
  misc_feature (26)..(32): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2137 - DNA, 32 bp, Artificial Sequence; identical to SEQ ID NO: 2115
  Pan degenerate oligonucleotide primer
  primer_bind (1)..(32)
  modified_base (1)..(1): base is a locked nucleic acid
  modified_base (15)..(15): base is a locked nucleic acid
  modified_base (16)..(16): base is a locked nucleic acid
  misc_feature (26)..(32): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2138 - DNA, 32 bp, Artificial Sequence; identical to SEQ ID NO: 2115
  Pan degenerate oligonucleotide primer
  primer_bind (1)..(32)
  modified_base (1)..(1): base is a locked nucleic acid
  modified_base (4)..(4): base is a locked nucleic acid
  modified_base (15)..(15): base is a locked nucleic acid
  misc_feature (26)..(32): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2139 - DNA, 33 bp, Artificial Sequence; identical to SEQ ID NO: 2116
  Pan degenerate oligonucleotide primer
  primer_bind (1)..(33)
  modified_base (1)..(1): base is a locked nucleic acid
  modified_base (2)..(2): base is a locked nucleic acid
  modified_base (16)..(16): base is a locked nucleic acid
  misc_feature (27)..(33): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2140 - DNA, 33 bp, Artificial Sequence; identical to SEQ ID NO: 2116
  Pan degenerate oligonucleotide primer
  primer_bind (1)..(33)
  modified_base (1)..(1): base is a locked nucleic acid
  modified_base (5)..(5): base is a locked nucleic acid
  modified_base (16)..(16): base is a locked nucleic acid
  misc_feature (27)..(33): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2141 - DNA, 33 bp, Artificial Sequence; identical to SEQ ID NO: 2116
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2142 - DNA, 40 bp, Artificial Sequence; identical to SEQ ID NO: 2113
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 116 to correspond to the nucleotides in an oligonucleotide probe downstream of the discriminating single nucleotide polymorphism.

SEQ ID NO: 2143 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 118 to correspond to the nucleotides in an oligonucleotide probe downstream of the discriminating single nucleotide polymorphism.
aatgcagtrtayttyctraadyyytyatvtaarggra

SEQ ID NO: 2144 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 118 to correspond to the nucleotides in an oligonucleotide probe downstream of the discriminating single nucleotide polymorphism.
raatgcagtrtayttyctraadyyytyatvtaarggra

SEQ ID NO: 2145 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.
gtraatgcagtrtayttyctraadyyytyatvtaarggra

SEQ ID NO: 2146 - DNA, 22 bp, Artificial Sequence
  Pan degenerate oligonucleotide primer
  primer_bind (1)..(22)
  misc_feature (16)..(22): Adaptor region of the pan degenerate antisense primer that adapts the probe-binding site downstream of codon 118 to correspond to the nucleotides in an oligonucleotide probe downstream of the discriminating single nucleotide polymorphism.
ctraadyyytyatvtaarggra

SEQ ID NO: 2147 - DNA, 23 bp, Artificial Sequence
  Pan degenerate oligonucleotide primer
  primer_bind (1)..(23)
  misc_feature (17)..(23): Adaptor region of the pan degenerate antisense primer that adapts the probe-binding site downstream of codon 118 to correspond to the nucleotides in an oligonucleotide probe downstream of the discriminating single nucleotide polymorphism.
yctraadyyytyatvtaarggra

SEQ ID NO: 2148 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.
gcagtrtayttyctraadyyytyatvtaarggra

SEQ ID NO: 2149 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 118 to correspond to the nucleotides in an oligonucleotide probe downstream of the discriminating single nucleotide polymorphism.
ryactrggtatrgtraatgcagtrtayttyctraadyyytyatmtaaagg

SEQ ID NO: 2150 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
aatgcagtrtayttyctraadyyytyatvtaarggran

SEQ ID NO: 2151 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
raatgcagtrtayttyctraadyyytyatvtaarggran

SEQ ID NO: 2152 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gtraatgcagtrtayttyctraadyyytyatvtaarggran

SEQ ID NO: 2153 - DNA, 23 bp, Artificial Sequence
  Pan degenerate oligonucleotide primer
  primer_bind (1)..(23)
  misc_feature (16)..(22): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (23)..(23): base is a locked nucleic acid
  misc_feature (23)..(23): n is a, c, g, or t
ctraadyyytyatvtaarggran

SEQ ID NO: 2154 - DNA, 24 bp, Artificial Sequence
  Pan degenerate oligonucleotide primer
  primer_bind (1)..(24)
  misc_feature (17)..(23): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (24)..(24): base is a locked nucleic acid
  misc_feature (24)..(24): n is a, c, g, or t
yctraadyyytyatvtaarggran

SEQ ID NO: 2155 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
gcagtrtayttyctraadyyytyatvtaarggran

SEQ ID NO: 2156 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 118 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
ryactrggtatrgtraatgcagtrtayttyctraadyyytyatmtaaaggn

SEQ ID NO: 2157 - DNA, 37 bp, Artificial Sequence; identical to SEQ ID NO: 2143
  Pan degenerate oligonucleotide primer
  primer_bind (1)..(37)
  modified_base (1)..(1): base is a locked nucleic acid
  modified_base (4)..(4): base is a locked nucleic acid
  modified_base (16)..(16): base is a locked nucleic acid
  misc_feature (31)..(37): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2158 - DNA, 37 bp, Artificial Sequence; identical to SEQ ID NO: 2143
  Pan degenerate oligonucleotide primer
  primer_bind (1)..(37)
  modified_base (1)..(1): base is a locked nucleic acid
  modified_base (15)..(15): base is a locked nucleic acid
  modified_base (16)..(16): base is a locked nucleic acid
  misc_feature (31)..(37): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2159 - DNA, 37 bp, Artificial Sequence; identical to SEQ ID NO: 2143
  Pan degenerate oligonucleotide primer
  primer_bind (1)..(37)
  modified_base (1)..(1): base is a locked nucleic acid
  modified_base (4)..(4): base is a locked nucleic acid
  modified_base (15)..(15): base is a locked nucleic acid
  misc_feature (31)..(37): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2160 - DNA, 38 bp, Artificial Sequence; identical to SEQ ID NO: 2144
  Pan degenerate oligonucleotide primer
  primer_bind (1)..(38)
  modified_base (1)..(1): base is a locked nucleic acid
  modified_base (2)..(2): base is a locked nucleic acid
  modified_base (16)..(16): base is a locked nucleic acid
  misc_feature (32)..(38): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2161 - DNA, 38 bp, Artificial Sequence; identical to SEQ ID NO: 2144
  Pan degenerate oligonucleotide primer
  primer_bind (1)..(38)
  modified_base (1)..(1): base is a locked nucleic acid
  modified_base (5)..(5): base is a locked nucleic acid
  modified_base (16)..(16): base is a locked nucleic acid
  misc_feature (32)..(38): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2162 - DNA, 38 bp, Artificial Sequence; identical to SEQ ID NO: 2144
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2163 - DNA, 40 bp, Artificial Sequence; identical to SEQ ID NO: 2145
  Pan degenerate oligonucleotide primer
  primer_bind (1)..(40)
  modified_base (1)..(1): base is a locked nucleic acid
  modified_base (3)..(3): base is a locked nucleic acid
  modified_base (7)..(7): base is a locked nucleic acid
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2164 - DNA, 40 bp, Artificial Sequence; identical to SEQ ID NO: 2145
  Pan degenerate oligonucleotide primer
  primer_bind (1)..(40)
  modified_base (1)..(1): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2165 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (6)..(6): base is a locked nucleic acid
  misc_feature (16)..(22): Adaptor region of the pan degenerate antisense primer that adapts the probe-binding site downstream of codon 118 to correspond to the nucleotides in an oligonucleotide probe downstream of the discriminating single nucleotide polymorphism.
ctraadyyytyatvtaarggra

SEQ ID NO: 2166 - DNA, 22 bp, Artificial Sequence
  Pan degenerate oligonucleotide primer
  primer_bind (1)..(22)
  modified_base (1)..(1): base is a locked nucleic acid
  modified_base (4)..(4): base is a locked nucleic acid
  modified_base (6)..(6): base is a locked nucleic acid
  misc_feature (16)..(22): Adaptor region of the pan degenerate antisense primer that adapts the probe-binding site downstream of codon 118 to correspond to the nucleotides in an oligonucleotide probe downstream of the discriminating single nucleotide polymorphism.
ctraadyyytyatvtaarggra

SEQ ID NO: 2167 - DNA, 22 bp, Artificial Sequence
  Pan degenerate oligonucleotide primer
  primer_bind (1)..(22)
  modified_base (1)..(1): base is a locked nucleic acid
  modified_base (3)..(3): base is a locked nucleic acid
  modified_base (4)..(4): base is a locked nucleic acid
  misc_feature (16)..(22): Adaptor region of the pan degenerate antisense primer that adapts the probe-binding site downstream of codon 118 to correspond to the nucleotides in an oligonucleotide probe downstream of the discriminating single nucleotide polymorphism.
ctraadyyytyatvtaarggra

SEQ ID NO: 2168 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (5)..(5): base is a locked nucleic acid
  misc_feature (17)..(23): Adaptor region of the pan degenerate antisense primer that adapts the probe-binding site downstream of codon 118 to correspond to the nucleotides in an oligonucleotide probe downstream of the discriminating single nucleotide polymorphism.
yctraadyyytyatvtaarggra

SEQ ID NO: 2169 - DNA, 23 bp, Artificial Sequence
  Pan degenerate oligonucleotide primer
  primer_bind (1)..(23)
  modified_base (1)..(1): base is a locked nucleic acid
  modified_base (4)..(4): base is a locked nucleic acid
  modified_base (5)..(5): base is a locked nucleic acid
  misc_feature (17)..(23): Adaptor region of the pan degenerate antisense primer that adapts the probe-binding site downstream of codon 118 to correspond to the nucleotides in an oligonucleotide probe downstream of the discriminating single nucleotide polymorphism.
yctraadyyytyatvtaarggra

SEQ ID NO: 2170 - DNA, 23 bp, Artificial Sequence
  Pan degenerate oligonucleotide primer
  primer_bind (1)..(23)
  modified_base (1)..(1): base is a locked nucleic acid
  modified_base (2)..(2): base is a locked nucleic acid
  modified_base (4)..(4): base is a locked nucleic acid
  misc_feature (17)..(23): Adaptor region of the pan degenerate antisense primer that adapts the probe-binding site downstream of codon 118 to correspond to the nucleotides in an oligonucleotide probe downstream of the discriminating single nucleotide polymorphism.
yctraadyyytyatvtaarggra

SEQ ID NO: 2171 - DNA, 34 bp, Artificial Sequence; identical to SEQ ID NO: 2148
  Pan degenerate oligonucleotide primer
  primer_bind (1)..(34)
  modified_base (1)..(1): base is a locked nucleic acid
  modified_base (12)..(12): base is a locked nucleic acid
  modified_base (15)..(15): base is a locked nucleic acid
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2172 - DNA, 34 bp, Artificial Sequence; identical to SEQ ID NO: 2148
  Pan degenerate oligonucleotide primer
  primer_bind (1)..(34)
  modified_base (1)..(1): base is a locked nucleic acid
  modified_base (13)..(13): base is a locked nucleic acid
  modified_base (15)..(15): base is a locked nucleic acid
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2173 - DNA, 34 bp, Artificial Sequence; identical to SEQ ID NO: 2148
  Pan degenerate oligonucleotide primer
  primer_bind (1)..(34)
  modified_base (1)..(1): base is a locked nucleic acid
  modified_base (12)..(12): base is a locked nucleic acid
  modified_base (13)..(13): base is a locked nucleic acid
  misc_feature (28)..(34): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2174 - DNA, 40 bp, Artificial Sequence; identical to SEQ ID NO: 2145
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 118 to correspond to the nucleotides in an oligonucleotide probe downstream of the discriminating single nucleotide polymorphism.

SEQ ID NO: 2175 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.
yacattrtaytgrtayctrayycctggtgtyt

SEQ ID NO: 2176 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 138 to correspond to the nucleotides in an oligonucleotide probe downstream of the discriminating single nucleotide polymorphism.
agyacattrtaytgrtayctrayycctggtgty

SEQ ID NO: 2177 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.
agyacattrtaytgrtayctrayycctggtgtyt

SEQ ID NO: 2178 - DNA, 35 bp, Artificial Sequence
  Pan degenerate oligonucleotide primer
  primer_bind (1)..(35)
  misc_feature (2)..(2): n is a, c, g, or t
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.
gnagyacattrtaytgrtayctrayycctggtgty

SEQ ID NO: 2179 - DNA, 40 bp, Artificial Sequence
  Pan degenerate oligonucleotide primer
  primer_bind (1)..(40)
  misc_feature (6)..(6): n is a, c, g, or t
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
tgtggnagyacattrtaytgrtayctrayycctggtgtyt

SEQ ID NO: 2180 - DNA, 40 bp, Artificial Sequence
  Pan degenerate oligonucleotide primer
  primer_bind (1)..(40)
  misc_feature (7)..(7): n is a, c, g, or t
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
ytgtggnagyacattrtaytgrtayctrayycctggtgty

SEQ ID NO: 2181 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 138 to correspond to the nucleotides in an oligonucleotide probe downstream of the discriminating single nucleotide polymorphism.
taytgrtayctrayycctggtgtyt

SEQ ID NO: 2182 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
trtaytgrtayctrayycctggtgty

SEQ ID NO: 2183 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
rtaytgrtayctrayycctggtgtyt

SEQ ID NO: 2184 - DNA, 27 bp, Artificial Sequence
  Pan degenerate oligonucleotide primer
  primer_bind (1)..(27)
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ttrtaytgrtayctrayycctggtgty

SEQ ID NO: 2185 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.
acattrtaytgrtayctrayycctggtgtyt

SEQ ID NO: 2186 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.
gyacattrtaytgrtayctrayycctggtgty

SEQ ID NO: 2187 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 138 to correspond to the nucleotides in an oligonucleotide probe downstream of the discriminating single nucleotide polymorphism.
ycctttccatccytgtggvagyacattrtaytgatayctrayycctggtgt

SEQ ID NO: 2188 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
yacattrtaytgrtayctrayycctggtgtytn

SEQ ID NO: 2189 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
agyacattrtaytgrtayctrayycctggtgtyn

SEQ ID NO: 2190 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
agyacattrtaytgrtayctrayycctggtgtytn

SEQ ID NO: 2191 - DNA, 36 bp, Artificial Sequence
  Pan degenerate oligonucleotide primer
  primer_bind (1)..(36)
  misc_feature (2)..(2): n is a, c, g, or t
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
gnagyacattrtaytgrtayctrayycctggtgtyn

SEQ ID NO: 2192 - DNA, 41 bp, Artificial Sequence
  Pan degenerate oligonucleotide primer
  primer_bind (1)..(41)
  misc_feature (6)..(6): n is a, c, g, or t
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tgtggnagyacattrtaytgrtayctrayycctggtgtytn

SEQ ID NO: 2193 - DNA, 41 bp, Artificial Sequence
  Pan degenerate oligonucleotide primer
  primer_bind (1)..(41)
  misc_feature (7)..(7): n is a, c, g, or t
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ytgtggnagyacattrtaytgrtayctrayycctggtgtyn

SEQ ID NO: 2194 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
taytgrtayctrayycctggtgtytn

SEQ ID NO: 2195 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
trtaytgrtayctrayycctggtgtyn

SEQ ID NO: 2196 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
rtaytgrtayctrayycctggtgtytn

SEQ ID NO: 2197 - DNA, 28 bp, Artificial Sequence
  Pan degenerate oligonucleotide primer
  primer_bind (1)..(28)
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (28)..(28): base is a locked nucleic acid
  misc_feature (28)..(28): n is a, c, g, or t
ttrtaytgrtayctrayycctggtgtyn

SEQ ID NO: 2198 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
acattrtaytgrtayctrayycctggtgtytn

SEQ ID NO: 2199 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
gyacattrtaytgrtayctrayycctggtgtyn

SEQ ID NO: 2200 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 138 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ycctttccatccytgtggvagyacattrtaytgatayctrayycctggtgtn

SEQ ID NO: 2201 - DNA, 32 bp, Artificial Sequence; identical to SEQ ID NO: 2175
  Pan degenerate oligonucleotide primer
  primer_bind (1)..(32)
  modified_base (1)..(1): base is a locked nucleic acid
  modified_base (2)..(2): base is a locked nucleic acid
  modified_base (8)..(8): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2202 - DNA, 33 bp, Artificial Sequence; identical to SEQ ID NO: 2176
  Pan degenerate oligonucleotide primer
  primer_bind (1)..(33)
  modified_base (1)..(1): base is a locked nucleic acid
  modified_base (2)..(2): base is a locked nucleic acid
  modified_base (8)..(8): base is a locked nucleic acid
  misc_feature (27)..(33): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2203 - DNA, 32 bp, Artificial Sequence; identical to SEQ ID NO: 2175
  Pan degenerate oligonucleotide primer
  primer_bind (1)..(32)
  modified_base (1)..(1): base is a locked nucleic acid
  modified_base (7)..(7): base is a locked nucleic acid
  modified_base (8)..(8): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2204 - DNA, 33 bp, Artificial Sequence; identical to SEQ ID NO: 2176
  Pan degenerate oligonucleotide primer
  primer_bind (1)..(33)
  modified_base (1)..(1): base is a locked nucleic acid
  modified_base (7)..(7): base is a locked nucleic acid
  modified_base (8)..(8): base is a locked nucleic acid
  misc_feature (27)..(33): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2205 - DNA, 32 bp, Artificial Sequence; identical to SEQ ID NO: 2175
  Pan degenerate oligonucleotide primer
  primer_bind (1)..(32)
  modified_base (1)..(1): base is a locked nucleic acid
  modified_base (2)..(2): base is a locked nucleic acid
  modified_base (7)..(7): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2206 - DNA, 33 bp, Artificial Sequence; identical to SEQ ID NO: 2176
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2207 - DNA, 34 bp, Artificial Sequence; identical to SEQ ID NO: 2177
  Pan degenerate oligonucleotide primer
  primer_bind (1)..(34)
  modified_base (1)..(1): base is a locked nucleic acid
  modified_base (3)..(3): base is a locked nucleic acid
  modified_base (9)..(9): base is a locked nucleic acid
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2208 - DNA, 35 bp, Artificial Sequence; identical to SEQ ID NO: 2178
  Pan degenerate oligonucleotide primer
  primer_bind (1)..(35)
  modified_base (1)..(1): base is a locked nucleic acid
  misc_feature (2)..(2): n is a, c, g, or t
  modified_base (3)..(3): base is a locked nucleic acid
  modified_base (9)..(9): base is a locked nucleic acid
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2209 - DNA, 34 bp, Artificial Sequence; identical to SEQ ID NO: 2177
  Pan degenerate oligonucleotide primer
  primer_bind (1)..(34)
  modified_base (1)..(1): base is a locked nucleic acid
  modified_base (4)..(4): base is a locked nucleic acid
  modified_base (9)..(9): base is a locked nucleic acid
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2210 - DNA, 35 bp, Artificial Sequence; identical to SEQ ID NO: 2178
  Pan degenerate oligonucleotide primer
  primer_bind (1)..(35)
  modified_base (1)..(1): base is a locked nucleic acid
  misc_feature (2)..(2): n is a, c, g, or t
  modified_base (4)..(4): base is a locked nucleic acid
  modified_base (9)..(9): base is a locked nucleic acid
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2211 - DNA, 34 bp, Artificial Sequence; identical to SEQ ID NO: 2177
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2212 - DNA, 35 bp, Artificial Sequence; identical to SEQ ID NO: 2178
  Pan degenerate oligonucleotide primer
  primer_bind (1)..(35)
  modified_base (1)..(1): base is a locked nucleic acid
  misc_feature (2)..(2): n is a, c, g, or t
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2213 - DNA, 40 bp, Artificial Sequence; identical to SEQ ID NO: 2179
  Pan degenerate oligonucleotide primer
  primer_bind (1)..(40)
  modified_base (6)..(6): base is a locked nucleic acid
  misc_feature (6)..(6): n is a, c, g, or t
  modified_base (7)..(7): base is a locked nucleic acid
  modified_base (10)..(10): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2214 - DNA, 40 bp, Artificial Sequence; identical to SEQ ID NO: 2180
  Pan degenerate oligonucleotide primer
  primer_bind (1)..(40)
  modified_base (5)..(5): base is a locked nucleic acid
  modified_base (6)..(6): base is a locked nucleic acid
  misc_feature (7)..(7): n is a, c, g, or t
  modified_base (9)..(9): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2215 - DNA, 40 bp, Artificial Sequence; identical to SEQ ID NO: 2179
  Pan degenerate oligonucleotide primer
  primer_bind (1)..(40)
  modified_base (6)..(6): base is a locked nucleic acid
  misc_feature (6)..(6): n is a, c, g, or t
  modified_base (9)..(9): base is a locked nucleic acid
  modified_base (10)..(10): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2216 - DNA, 40 bp, Artificial Sequence; identical to SEQ ID NO: 2180
  Pan degenerate oligonucleotide primer
  primer_bind (1)..(40)
  modified_base (5)..(5): base is a locked nucleic acid
  misc_feature (7)..(7): n is a, c, g, or t
  modified_base (8)..(8): base is a locked nucleic acid
  modified_base (9)..(9): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2217 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (9)..(9): base is a locked nucleic acid
  misc_feature (19)..(25): Adaptor region of the pan degenerate antisense primer that adapts the probe-binding site downstream of codon 138 to correspond to the nucleotides in an oligonucleotide probe downstream of the discriminating single nucleotide polymorphism.
taytgrtayctrayycctggtgtyt

SEQ ID NO: 2218 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (9)..(9): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
trtaytgrtayctrayycctggtgty

SEQ ID NO: 2219 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (9)..(9): base is a locked nucleic acid
  misc_feature (19)..(25): Adaptor region of the pan degenerate antisense primer that adapts the probe-binding site downstream of codon 138 to correspond to the nucleotides in an oligonucleotide probe downstream of the discriminating single nucleotide polymorphism.
taytgrtayctrayycctggtgtyt

SEQ ID NO: 2220 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (9)..(9): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
trtaytgrtayctrayycctggtgty

SEQ ID NO: 2221 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (4)..(4): base is a locked nucleic acid
  misc_feature (19)..(25): Adaptor region of the pan degenerate antisense primer that adapts the probe-binding site downstream of codon 138 to correspond to the nucleotides in an oligonucleotide probe downstream of the discriminating single nucleotide polymorphism.
taytgrtayctrayycctggtgtyt

SEQ ID NO: 2222 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
trtaytgrtayctrayycctggtgty

SEQ ID NO: 2223 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (5)..(5): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
rtaytgrtayctrayycctggtgtyt

SEQ ID NO: 2224 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (5)..(5): base is a locked nucleic acid
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ttrtaytgrtayctrayycctggtgty

SEQ ID NO: 2225 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (5)..(5): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
rtaytgrtayctrayycctggtgtyt

SEQ ID NO: 2226 - DNA, 27 bp, Artificial Sequence
  Pan degenerate oligonucleotide primer
  primer_bind (1)..(27)
  modified_base (1)..(1): base is a locked nucleic acid
  modified_base (4)..(4): base is a locked nucleic acid
  modified_base (5)..(5): base is a locked nucleic acid
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ttrtaytgrtayctrayycctggtgty

SEQ ID NO: 2227 - DNA, 26 bp, Artificial Sequence
  Pan degenerate oligonucleotide primer
  primer_bind (1)..(26)
  modified_base (1)..(1): base is a locked nucleic acid
  modified_base (2)..(2): base is a locked nucleic acid
  modified_base (4)..(4): base is a locked nucleic acid
  misc_feature (20)..(26): Adaptor region of the pan degenerate antisense primer that adapts the probe-binding site downstream of codon 138 to correspond to the nucleotides in an oligonucleotide probe downstream of the discriminating single nucleotide polymorphism.
rtaytgrtayctrayycctggtgtyt

SEQ ID NO: 2228 - DNA, 27 bp, Artificial Sequence
  Pan degenerate oligonucleotide primer
  primer_bind (1)..(27)
  modified_base (1)..(1): base is a locked nucleic acid
  modified_base (2)..(2): base is a locked nucleic acid
  modified_base (4)..(4): base is a locked nucleic acid
  misc_feature (21)..(27): Adaptor region of the pan degenerate antisense primer that adapts the probe-binding site downstream of codon 138 to correspond to the nucleotides in an oligonucleotide probe downstream of the discriminating single nucleotide polymorphism.
ttrtaytgrtayctrayycctggtgty

SEQ ID NO: 2229 - DNA, 31 bp, Artificial Sequence; identical to SEQ ID NO: 2185
  Pan degenerate oligonucleotide primer
  primer_bind (1)..(31)
  modified_base (1)..(1): base is a locked nucleic acid
  modified_base (6)..(6): base is a locked nucleic acid
  modified_base (9)..(9): base is a locked nucleic acid
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2230 - DNA, 32 bp, Artificial Sequence; identical to SEQ ID NO: 2186
  Pan degenerate oligonucleotide primer
  primer_bind (1)..(32)
  modified_base (1)..(1): base is a locked nucleic acid
  modified_base (6)..(6): base is a locked nucleic acid
  modified_base (9)..(9): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2231 - DNA, 31 bp, Artificial Sequence; identical to SEQ ID NO: 2185
  Pan degenerate oligonucleotide primer
  primer_bind (1)..(31)
  modified_base (1)..(1): base is a locked nucleic acid
  modified_base (7)..(7): base is a locked nucleic acid
  modified_base (9)..(9): base is a locked nucleic acid
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2232 - DNA, 32 bp, Artificial Sequence; identical to SEQ ID NO: 2186
  Pan degenerate oligonucleotide primer
  primer_bind (1)..(32)
  modified_base (1)..(1): base is a locked nucleic acid
  modified_base (7)..(7): base is a locked nucleic acid
  modified_base (9)..(9): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2233 - DNA, 31 bp, Artificial Sequence; identical to SEQ ID NO: 2185
  Pan degenerate oligonucleotide primer
  primer_bind (1)..(31)
  modified_base (1)..(1): base is a locked nucleic acid
  modified_base (6)..(6): base is a locked nucleic acid
  modified_base (7)..(7): base is a locked nucleic acid
  misc_feature (25)..(31): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2234 - DNA, 32 bp, Artificial Sequence; identical to SEQ ID NO: 2186
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2235 - DNA, 40 bp, Artificial Sequence; identical to SEQ ID NO: 2179
  Pan degenerate oligonucleotide primer
  primer_bind (1)..(40)
  modified_base (6)..(6): base is a locked nucleic acid
  misc_feature (6)..(6): n is a, c, g, or t
  modified_base (7)..(7): base is a locked nucleic acid
  modified_base (9)..(9): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2236 - DNA, 40 bp, Artificial Sequence; identical to SEQ ID NO: 2180
  Pan degenerate oligonucleotide primer
  primer_bind (1)..(40)
  modified_base (5)..(5): base is a locked nucleic acid
  modified_base (6)..(6): base is a locked nucleic acid
  misc_feature (7)..(7): n is a, c, g, or t
  modified_base (8)..(8): base is a locked nucleic acid
  misc_feature (34)..(40): Adaptor region of the pan degenerate antisense primer that adapts the probe-binding site downstream of codon 138 to correspond to the nucleotides in an oligonucleotide probe downstream of the discriminating single nucleotide polymorphism.

SEQ ID NO: 2237 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 151 to correspond to the nucleotides in an oligonucleotide probe downstream of the discriminating single nucleotide polymorphism.
taarattyttgtcatrctrshytgraatatygcyggtgaycctttccatcc

SEQ ID NO: 2238 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 151 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
taarattyttgtcatrctrshytgraatatygcyggtgaycctttccatccn

SEQ ID NO: 2239 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.
ctacatayaartcatccayrtattgrtaratv

SEQ ID NO: 2240 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 179 to correspond to the nucleotides in an oligonucleotide probe downstream of the discriminating single nucleotide polymorphism.
acatayaartcatccayrtattgrtaratva

SEQ ID NO: 2241 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 179 to correspond to the nucleotides in an oligonucleotide probe downstream of the discriminating single nucleotide polymorphism.
cctacatayaartcatccayrtattgrtaratv

SEQ ID NO: 2242 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.
tacatayaartcatccayrtattgrtaratva

SEQ ID NO: 2243 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.
rtcwgakcctacatayaartcatccayrtattgrtaratv

SEQ ID NO: 2244 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.
tcwgakcctacatayaartcatccayrtattgrtaratva

SEQ ID NO: 2245 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 179 to correspond to the nucleotides in an oligonucleotide probe downstream of the discriminating single nucleotide polymorphism.
ayaartcatccayrtattgrtaratv

SEQ ID NO: 2246 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 179 to correspond to the nucleotides in an oligonucleotide probe downstream of the discriminating single nucleotide polymorphism.
aartcatccayrtattgrtaratva

SEQ ID NO: 2247 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
catayaartcatccayrtattgrtaratv

SEQ ID NO: 2248 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 179 to correspond to the nucleotides in an oligonucleotide probe downstream of the discriminating single nucleotide polymorphism.
tayaartcatccayrtattgrtaratva

SEQ ID NO: 2249 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 179 to correspond to the nucleotides in an oligonucleotide probe downstream of the discriminating single nucleotide polymorphism.
acatayaartcatccayrtattgrtaratv

SEQ ID NO: 2250 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
atayaartcatccayrtattgrtaratva

SEQ ID NO: 2251 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 179 to correspond to the nucleotides in an oligonucleotide probe downstream of the discriminating single nucleotide polymorphism.
yyctatytctaartcagaycctacatayaartcatccatrtaytgatagat

SEQ ID NO: 2252 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ctacatayaartcatccayrtattgrtaratvn

SEQ ID NO: 2253 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
acatayaartcatccayrtattgrtaratvan

SEQ ID NO: 2254 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
cctacatayaartcatccayrtattgrtaratvn

SEQ ID NO: 2255 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tacatayaartcatccayrtattgrtaratvan

SEQ ID NO: 2256 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
rtcwgakcctacatayaartcatccayrtattgrtaratvn

SEQ ID NO: 2257 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tcwgakcctacatayaartcatccayrtattgrtaratvan

SEQ ID NO: 2258 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
ayaartcatccayrtattgrtaratvn

SEQ ID NO: 2259 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
aartcatccayrtattgrtaratvan

SEQ ID NO: 2260 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
catayaartcatccayrtattgrtaratvn

SEQ ID NO: 2261 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tayaartcatccayrtattgrtaratvan

SEQ ID NO: 2262 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
acatayaartcatccayrtattgrtaratvn

SEQ ID NO: 2263 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
atayaartcatccayrtattgrtaratvan

SEQ ID NO: 2264 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 179 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
yyctatytctaartcagaycctacatayaartcatccatrtaytgatagatn

SEQ ID NO: 2265 - DNA, 32 bp, Artificial Sequence; identical to SEQ ID NO: 2239
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2266 - DNA, 31 bp, Artificial Sequence; identical to SEQ ID NO: 2240
  Pan degenerate oligonucleotide primer
  primer_bind (1)..(31)
  modified_base (1)..(1): base is a locked nucleic acid
  modified_base (3)..(3): base is a locked nucleic acid
  modified_base (7)..(7): base is a locked nucleic acid
  misc_feature (25)..(31): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2267 - DNA, 32 bp, Artificial Sequence; identical to SEQ ID NO: 2239
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2268 - DNA, 31 bp, Artificial Sequence; identical to SEQ ID NO: 2240
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2269 - DNA, 32 bp, Artificial Sequence; identical to SEQ ID NO: 2239
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2270 - DNA, 31 bp, Artificial Sequence; identical to SEQ ID NO: 2240
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2271 - DNA, 33 bp, Artificial Sequence; identical to SEQ ID NO: 2241
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2272 - DNA, 32 bp, Artificial Sequence; identical to SEQ ID NO: 2242
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2273 - DNA, 33 bp, Artificial Sequence; identical to SEQ ID NO: 2241
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2274 - DNA, 32 bp, Artificial Sequence; identical to SEQ ID NO: 2242
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2275 - DNA, 33 bp, Artificial Sequence; identical to SEQ ID NO: 2241
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2276 - DNA, 32 bp, Artificial Sequence; identical to SEQ ID NO: 2242
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2277 - DNA, 40 bp, Artificial Sequence; identical to SEQ ID NO: 2243
  Pan degenerate oligonucleotide primer
  primer_bind (1)..(40)
  modified_base (3)..(3): base is a locked nucleic acid
  modified_base (8)..(8): base is a locked nucleic acid
  modified_base (11)..(11): base is a locked nucleic acid
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2278 - DNA, 40 bp, Artificial Sequence; identical to SEQ ID NO: 2244
  Pan degenerate oligonucleotide primer
  primer_bind (1)..(40)
  modified_base (1)..(1): base is a locked nucleic acid
  modified_base (4)..(4): base is a locked nucleic acid
  modified_base (10)..(10): base is a locked nucleic acid
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2279 - DNA, 40 bp, Artificial Sequence; identical to SEQ ID NO: 2243
  Pan degenerate oligonucleotide primer
  primer_bind (1)..(40)
  modified_base (3)..(3): base is a locked nucleic acid
  modified_base (9)..(9): base is a locked nucleic acid
  modified_base (11)..(11): base is a locked nucleic acid
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2280 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (5)..(5): base is a locked nucleic acid
  misc_feature (20)..(26): Adaptor region of the pan degenerate antisense primer that adapts the probe-binding site downstream of codon 179 to correspond to the nucleotides in an oligonucleotide probe downstream of the discriminating single nucleotide polymorphism.
ayaartcatccayrtattgrtaratv

SEQ ID NO: 2281 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (5)..(5): base is a locked nucleic acid
  misc_feature (19)..(25): Adaptor region of the pan degenerate antisense primer that adapts the probe-binding site downstream of codon 179 to correspond to the nucleotides in an oligonucleotide probe downstream of the discriminating single nucleotide polymorphism.
aartcatccayrtattgrtaratva

SEQ ID NO: 2282 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (5)..(5): base is a locked nucleic acid
  misc_feature (20)..(26): Adaptor region of the pan degenerate antisense primer that adapts the probe-binding site downstream of codon 179 to correspond to the nucleotides in an oligonucleotide probe downstream of the discriminating single nucleotide polymorphism.
ayaartcatccayrtattgrtaratv

SEQ ID NO: 2283 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (5)..(5): base is a locked nucleic acid
  misc_feature (19)..(25): Adaptor region of the pan degenerate antisense primer that adapts the probe-binding site downstream of codon 179 to correspond to the nucleotides in an oligonucleotide probe downstream of the discriminating single nucleotide polymorphism.
aartcatccayrtattgrtaratva

SEQ ID NO: 2284 - DNA, 26 bp, Artificial Sequence
  Pan degenerate oligonucleotide primer
  primer_bind (1)..(26)
  modified_base (1)..(1): base is a locked nucleic acid
  modified_base (3)..(3): base is a locked nucleic acid
  modified_base (4)..(4): base is a locked nucleic acid
  misc_feature (20)..(26): Adaptor region of the pan degenerate antisense primer that adapts the probe-binding site downstream of codon 179 to correspond to the nucleotides in an oligonucleotide probe downstream of the discriminating single nucleotide polymorphism.
ayaartcatccayrtattgrtaratv

SEQ ID NO: 2285 - DNA, 25 bp, Artificial Sequence
  Pan degenerate oligonucleotide primer
  primer_bind (1)..(25)
  modified_base (1)..(1): base is a locked nucleic acid
  modified_base (3)..(3): base is a locked nucleic acid
  modified_base (4)..(4): base is a locked nucleic acid
  misc_feature (19)..(25): Adaptor region of the pan degenerate antisense primer that adapts the probe-binding site downstream of codon 179 to correspond to the nucleotides in an oligonucleotide probe downstream of the discriminating single nucleotide polymorphism.
aartcatccayrtattgrtaratva

SEQ ID NO: 2286 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
catayaartcatccayrtattgrtaratv

SEQ ID NO: 2287 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 179 to correspond to the nucleotides in an oligonucleotide probe downstream of the discriminating single nucleotide polymorphism.
tayaartcatccayrtattgrtaratva

SEQ ID NO: 2288 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
catayaartcatccayrtattgrtaratv

SEQ ID NO: 2289 - DNA, 28 bp, Artificial Sequence
  Pan degenerate oligonucleotide primer
  primer_bind (1)..(28)
  modified_base (1)..(1): base is a locked nucleic acid
  modified_base (6)..(6): base is a locked nucleic acid
  modified_base (7)..(7): base is a locked nucleic acid
  misc_feature (22)..(28): Adaptor region of the pan degenerate antisense primer that adapts the probe-binding site downstream of codon 179 to correspond to the nucleotides in an oligonucleotide probe downstream of the discriminating single nucleotide polymorphism.
tayaartcatccayrtattgrtaratva

SEQ ID NO: 2290 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
catayaartcatccayrtattgrtaratv

SEQ ID NO: 2291 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 179 to correspond to the nucleotides in an oligonucleotide probe downstream of the discriminating single nucleotide polymorphism.
tayaartcatccayrtattgrtaratva

SEQ ID NO: 2292 - DNA, 30 bp, Artificial Sequence; identical to SEQ ID NO: 2249
  Pan degenerate oligonucleotide primer
  primer_bind (1)..(30)
  modified_base (1)..(1): base is a locked nucleic acid
  modified_base (2)..(2): base is a locked nucleic acid
  modified_base (7)..(7): base is a locked nucleic acid
  misc_feature (24)..(30): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2293 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (7)..(7): base is a locked nucleic acid
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
atayaartcatccayrtattgrtaratva

SEQ ID NO: 2294 - DNA, 30 bp, Artificial Sequence; identical to SEQ ID NO: 2249
  Pan degenerate oligonucleotide primer
  primer_bind (1)..(30)
  modified_base (1)..(1): base is a locked nucleic acid
  modified_base (5)..(5): base is a locked nucleic acid
  modified_base (7)..(7): base is a locked nucleic acid
  misc_feature (24)..(30): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2295 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (7)..(7): base is a locked nucleic acid
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
atayaartcatccayrtattgrtaratva

SEQ ID NO: 2296 - DNA, 30 bp, Artificial Sequence; identical to SEQ ID NO: 2249
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2297 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 179 to correspond to the nucleotides in an oligonucleotide probe downstream of the discriminating single nucleotide polymorphism.
atayaartcatccayrtattgrtaratva

SEQ ID NO: 2298 - DNA, 40 bp, Artificial Sequence; identical to SEQ ID NO: 2243
  Pan degenerate oligonucleotide primer
  primer_bind (1)..(40)
  modified_base (3)..(3): base is a locked nucleic acid
  modified_base (8)..(8): base is a locked nucleic acid
  modified_base (9)..(9): base is a locked nucleic acid
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2299 - DNA, 40 bp, Artificial Sequence; identical to SEQ ID NO: 2244
  Pan degenerate oligonucleotide primer
  primer_bind (1)..(40)
  modified_base (4)..(4): base is a locked nucleic acid
  modified_base (9)..(9): base is a locked nucleic acid
  modified_base (10)..(10): base is a locked nucleic acid
  misc_feature (34)..(40): Adaptor region of the pan degenerate antisense primer that adapts the probe-binding site downstream of codon 179 to correspond to the nucleotides in an oligonucleotide probe downstream of the discriminating single nucleotide polymorphism.

SEQ ID NO: 2300 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 181 to correspond to the nucleotides in an oligonucleotide probe downstream of the discriminating single nucleotide polymorphism.
aartcwgakcctacatayaartcatccayrtattgr

SEQ ID NO: 2301 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 181 to correspond to the nucleotides in an oligonucleotide probe downstream of the discriminating single nucleotide polymorphism.
ctaartcwgakcctacatayaartcatccayrtattgr

SEQ ID NO: 2302 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 181 to correspond to the nucleotides in an oligonucleotide probe downstream of the discriminating single nucleotide polymorphism.
ytctaartcwgakcctacatayaartcatccayrtattgr

SEQ ID NO: 2303 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 181 to correspond to the nucleotides in an oligonucleotide probe downstream of the discriminating single nucleotide polymorphism.
gakcctacatayaartcatccayrtattgr

SEQ ID NO: 2304 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 181 to correspond to the nucleotides in an oligonucleotide probe downstream of the discriminating single nucleotide polymorphism.
cwgakcctacatayaartcatccayrtattgr

SEQ ID NO: 2305 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 181 to correspond to the nucleotides in an oligonucleotide probe downstream of the discriminating single nucleotide polymorphism.
artcwgakcctacatayaartcatccayrtattgr

SEQ ID NO: 2306 - DNA, 52 bp, Artificial Sequence
  Pan degenerate oligonucleotide primer
  primer_bind (1)..(52)
  misc_feature (46)..(52): Adaptor region of the pan degenerate antisense primer that adapts the probe-binding site downstream of codon 181 to correspond to the nucleotides in an oligonucleotide probe downstream of the discriminating single nucleotide polymorphism.
trtgytgyyctatytctaartcagaycctacatayaartcatccatgtattg

SEQ ID NO: 2307 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 181 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
aartcwgakcctacatayaartcatccayrtattgrn

SEQ ID NO: 2308 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 181 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ctaartcwgakcctacatayaartcatccayrtattgrn

SEQ ID NO: 2309 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 181 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ytctaartcwgakcctacatayaartcatccayrtattgrn

SEQ ID NO: 2310 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 181 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
gakcctacatayaartcatccayrtattgrn

SEQ ID NO: 2311 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 181 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
cwgakcctacatayaartcatccayrtattgrn

SEQ ID NO: 2312 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 181 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
artcwgakcctacatayaartcatccayrtattgrn

SEQ ID NO: 2313 - DNA, 53 bp, Artificial Sequence
  Pan degenerate oligonucleotide primer
  primer_bind (1)..(53)
  misc_feature (46)..(52): Adaptor region of the pan degenerate antisense primer that adapts the probe-binding site downstream of codon 181 to correspond to the nucleotides in an oligonucleotide probe downstream of the discriminating single nucleotide polymorphism.
  modified_base (53)..(53): base is a locked nucleic acid
  misc_feature (53)..(53): n is a, c, g, or t
trtgytgyyctatytctaartcagaycctacatayaartcatccatgtattgn

SEQ ID NO: 2314 - DNA, 36 bp, Artificial Sequence; identical to SEQ ID NO: 2300
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (30)..(36): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2315 - DNA, 36 bp, Artificial Sequence; identical to SEQ ID NO: 2300
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (30)..(36): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2316 - DNA, 36 bp, Artificial Sequence; identical to SEQ ID NO: 2300
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2317 - DNA, 38 bp, Artificial Sequence; identical to SEQ ID NO: 2301
  Pan degenerate oligonucleotide primer
  primer_bind (1)..(38)
  modified_base (1)..(1): base is a locked nucleic acid
  modified_base (3)..(3): base is a locked nucleic acid
  modified_base (7)..(7): base is a locked nucleic acid
  misc_feature (32)..(38): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2318 - DNA, 38 bp, Artificial Sequence; identical to SEQ ID NO: 2301
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2319 - DNA, 38 bp, Artificial Sequence; identical to SEQ ID NO: 2301
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2320 - DNA, 40 bp, Artificial Sequence; identical to SEQ ID NO: 2302
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2321 - DNA, 40 bp, Artificial Sequence; identical to SEQ ID NO: 2302
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2322 - DNA, 30 bp, Artificial Sequence; identical to SEQ ID NO: 2303
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2323 - DNA, 30 bp, Artificial Sequence; identical to SEQ ID NO: 2303
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2324 - DNA, 30 bp, Artificial Sequence; identical to SEQ ID NO: 2303
  Pan degenerate oligonucleotide primer
  primer_bind (1)..(30)
  modified_base (1)..(1): base is a locked nucleic acid
  modified_base (2)..(2): base is a locked nucleic acid
  modified_base (3)..(3): base is a locked nucleic acid
  misc_feature (24)..(30): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2325 - DNA, 32 bp, Artificial Sequence; identical to SEQ ID NO: 2304
  Pan degenerate oligonucleotide primer
  primer_bind (1)..(32)
  modified_base (1)..(1): base is a locked nucleic acid
  modified_base (3)..(3): base is a locked nucleic acid
  modified_base (5)..(5): base is a locked nucleic acid
  misc_feature (26)..(32): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2326 - DNA, 32 bp, Artificial Sequence; identical to SEQ ID NO: 2304
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2327 - DNA, 32 bp, Artificial Sequence; identical to SEQ ID NO: 2304
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2328 - DNA, 35 bp, Artificial Sequence; identical to SEQ ID NO: 2305
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2329 - DNA, 35 bp, Artificial Sequence; identical to SEQ ID NO: 2305
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2330 - DNA, 35 bp, Artificial Sequence; identical to SEQ ID NO: 2305
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2331 - DNA, 40 bp, Artificial Sequence; identical to SEQ ID NO: 2302
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 181 to correspond to the nucleotides in an oligonucleotide probe downstream of the discriminating single nucleotide polymorphism.

SEQ ID NO: 2332 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.
yctatytctaartcwgakcctacatayaartcatcca

SEQ ID NO: 2333 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.
tgyyctatytctaartcwgakcctacatayaartcatc

SEQ ID NO: 2334 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.
yyctatytctaartcwgakcctacatayaartcatcca

SEQ ID NO: 2335 - DNA, 39 bp, Artificial Sequence
  Pan degenerate oligonucleotide primer
  primer_bind (1)..(39)
  misc_feature (33)..(39): Adaptor region of the pan degenerate antisense primer that adapts the probe-binding site downstream of codon 184 to correspond to the nucleotides in an oligonucleotide probe downstream of the discriminating single nucleotide polymorphism.
ytgyyctatytctaartcwgakcctacatayaartcatc

SEQ ID NO: 2336 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.
tgyyctatytctaartcwgakcctacatayaartcatcca

SEQ ID NO: 2337 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.
gytgyyctatytctaartcwgakcctacatayaartcatc

SEQ ID NO: 2338 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 184 to correspond to the nucleotides in an oligonucleotide probe downstream of the discriminating single nucleotide polymorphism.
atytctaartcwgakcctacatayaartcatcca

SEQ ID NO: 2339 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 184 to correspond to the nucleotides in an oligonucleotide probe downstream of the discriminating single nucleotide polymorphism.
tatytctaartcwgakcctacatayaartcatc

SEQ ID NO: 2340 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 184 to correspond to the nucleotides in an oligonucleotide probe downstream of the discriminating single nucleotide polymorphism.
tatytctaartcwgakcctacatayaartcatcca

SEQ ID NO: 2341 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.
yyctatytctaartcwgakcctacatayaartcatc

SEQ ID NO: 2342 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.
ctatytctaartcwgakcctacatayaartcatcca

SEQ ID NO: 2343 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.
gyyctatytctaartcwgakcctacatayaartcatc

SEQ ID NO: 2344 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 184 to correspond to the nucleotides in an oligonucleotide probe downstream of the discriminating single nucleotide polymorphism.
tttrytctrtgytgyyctatytctaartcagaycctacatayaartcatc

SEQ ID NO: 2345 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
yctatytctaartcwgakcctacatayaartcatccan

SEQ ID NO: 2346 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
tgyyctatytctaartcwgakcctacatayaartcatcn

SEQ ID NO: 2347 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
yyctatytctaartcwgakcctacatayaartcatccan

SEQ ID NO: 2348 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
ytgyyctatytctaartcwgakcctacatayaartcatcn

SEQ ID NO: 2349 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tgyyctatytctaartcwgakcctacatayaartcatccan

SEQ ID NO: 2350 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gytgyyctatytctaartcwgakcctacatayaartcatcn

SEQ ID NO: 2351 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
atytctaartcwgakcctacatayaartcatccan

SEQ ID NO: 2352 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tatytctaartcwgakcctacatayaartcatcn

SEQ ID NO: 2353 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
tatytctaartcwgakcctacatayaartcatccan

SEQ ID NO: 2354 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
yyctatytctaartcwgakcctacatayaartcatcn

SEQ ID NO: 2355 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
ctatytctaartcwgakcctacatayaartcatccan

SEQ ID NO: 2356 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
gyyctatytctaartcwgakcctacatayaartcatcn

SEQ ID NO: 2357 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 184 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
tttrytctrtgytgyyctatytctaartcagaycctacatayaartcatcn

SEQ ID NO: 2358 - DNA, 37 bp, Artificial Sequence; identical to SEQ ID NO: 2332
  Pan degenerate oligonucleotide primer
  primer_bind (1)..(37)
  modified_base (1)..(1): base is a locked nucleic acid
  modified_base (2)..(2): base is a locked nucleic acid
  modified_base (4)..(4): base is a locked nucleic acid
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2359 - DNA, 38 bp, Artificial Sequence; identical to SEQ ID NO: 2333
  Pan degenerate oligonucleotide primer
  primer_bind (1)..(38)
  modified_base (1)..(1): base is a locked nucleic acid
  modified_base (2)..(2): base is a locked nucleic acid
  modified_base (6)..(6): base is a locked nucleic acid
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2360 - DNA, 37 bp, Artificial Sequence; identical to SEQ ID NO: 2332
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2361 - DNA, 38 bp, Artificial Sequence; identical to SEQ ID NO: 2333
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2362 - DNA, 37 bp, Artificial Sequence; identical to SEQ ID NO: 2332
  Pan degenerate oligonucleotide primer
  primer_bind (1)..(37)
  modified_base (1)..(1): base is a locked nucleic acid
  modified_base (2)..(2): base is a locked nucleic acid
  modified_base (3)..(3): base is a locked nucleic acid
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2363 - DNA, 38 bp, Artificial Sequence; identical to SEQ ID NO: 2333
  Pan degenerate oligonucleotide primer
  primer_bind (1)..(38)
  modified_base (1)..(1): base is a locked nucleic acid
  modified_base (2)..(2): base is a locked nucleic acid
  modified_base (3)..(3): base is a locked nucleic acid
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2364 - DNA, 38 bp, Artificial Sequence; identical to SEQ ID NO: 2334
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2365 - DNA, 39 bp, Artificial Sequence; identical to SEQ ID NO: 2335
  Pan degenerate oligonucleotide primer
  primer_bind (1)..(39)
  modified_base (1)..(1): base is a locked nucleic acid
  modified_base (2)..(2): base is a locked nucleic acid
  modified_base (4)..(4): base is a locked nucleic acid
  misc_feature (33)..(39): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2366 - DNA, 38 bp, Artificial Sequence; identical to SEQ ID NO: 2334
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2367 - DNA, 39 bp, Artificial Sequence; identical to SEQ ID NO: 2335
  Pan degenerate oligonucleotide primer
  primer_bind (1)..(39)
  modified_base (1)..(1): base is a locked nucleic acid
  modified_base (3)..(3): base is a locked nucleic acid
  modified_base (4)..(4): base is a locked nucleic acid
  misc_feature (33)..(39): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2368 - DNA, 38 bp, Artificial Sequence; identical to SEQ ID NO: 2334
  Pan degenerate oligonucleotide primer
  primer_bind (1)..(38)
  modified_base (1)..(1): base is a locked nucleic acid
  modified_base (2)..(2): base is a locked nucleic acid
  modified_base (3)..(3): base is a locked nucleic acid
  misc_feature (32)..(38): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2369 - DNA, 39 bp, Artificial Sequence; identical to SEQ ID NO: 2335
  Pan degenerate oligonucleotide primer
  primer_bind (1)..(39)
  modified_base (1)..(1): base is a locked nucleic acid
  modified_base (2)..(2): base is a locked nucleic acid
  modified_base (3)..(3): base is a locked nucleic acid
  misc_feature (33)..(39): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2370 - DNA, 40 bp, Artificial Sequence; identical to SEQ ID NO: 2336
  Pan degenerate oligonucleotide primer
  primer_bind (1)..(40)
  modified_base (3)..(3): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2371 - DNA, 40 bp, Artificial Sequence; identical to SEQ ID NO: 2337
  Pan degenerate oligonucleotide primer
  primer_bind (1)..(40)
  modified_base (1)..(1): base is a locked nucleic acid
  modified_base (2)..(2): base is a locked nucleic acid
  modified_base (4)..(4): base is a locked nucleic acid
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2372 - DNA, 40 bp, Artificial Sequence; identical to SEQ ID NO: 2336
  Pan degenerate oligonucleotide primer
  primer_bind (1)..(40)
  modified_base (4)..(4): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2373 - DNA, 40 bp, Artificial Sequence; identical to SEQ ID NO: 2337
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2374 - DNA, 34 bp, Artificial Sequence; identical to SEQ ID NO: 2338
  Pan degenerate oligonucleotide primer
  primer_bind (1)..(34)
  modified_base (1)..(1): base is a locked nucleic acid
  modified_base (4)..(4): base is a locked nucleic acid
  modified_base (15)..(15): base is a locked nucleic acid
  misc_feature (28)..(34): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2375 - DNA, 33 bp, Artificial Sequence; identical to SEQ ID NO: 2339
  Pan degenerate oligonucleotide primer
  primer_bind (1)..(33)
  modified_base (1)..(1): base is a locked nucleic acid
  modified_base (7)..(7): base is a locked nucleic acid
  modified_base (13)..(13): base is a locked nucleic acid
  misc_feature (27)..(33): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2376 - DNA, 34 bp, Artificial Sequence; identical to SEQ ID NO: 2338
  Pan degenerate oligonucleotide primer
  primer_bind (1)..(34)
  modified_base (1)..(1): base is a locked nucleic acid
  modified_base (10)..(10): base is a locked nucleic acid
  modified_base (15)..(15): base is a locked nucleic acid
  misc_feature (28)..(34): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2377 - DNA, 33 bp, Artificial Sequence; identical to SEQ ID NO: 2339
  Pan degenerate oligonucleotide primer
  primer_bind (1)..(33)
  modified_base (1)..(1): base is a locked nucleic acid
  modified_base (12)..(12): base is a locked nucleic acid
  modified_base (13)..(13): base is a locked nucleic acid
  misc_feature (27)..(33): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2378 - DNA, 34 bp, Artificial Sequence; identical to SEQ ID NO: 2338
  Pan degenerate oligonucleotide primer
  primer_bind (1)..(34)
  modified_base (1)..(1): base is a locked nucleic acid
  modified_base (4)..(4): base is a locked nucleic acid
  modified_base (10)..(10): base is a locked nucleic acid
  misc_feature (28)..(34): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2379 - DNA, 33 bp, Artificial Sequence; identical to SEQ ID NO: 2339
  Pan degenerate oligonucleotide primer
  primer_bind (1)..(33)
  modified_base (1)..(1): base is a locked nucleic acid
  modified_base (7)..(7): base is a locked nucleic acid
  modified_base (12)..(12): base is a locked nucleic acid
  misc_feature (27)..(33): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2380 - DNA, 35 bp, Artificial Sequence; identical to SEQ ID NO: 2340
  Pan degenerate oligonucleotide primer
  primer_bind (1)..(35)
  modified_base (1)..(1): base is a locked nucleic acid
  modified_base (2)..(2): base is a locked nucleic acid
  modified_base (11)..(11): base is a locked nucleic acid
  misc_feature (29)..(35): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2381 - DNA, 36 bp, Artificial Sequence; identical to SEQ ID NO: 2341
  Pan degenerate oligonucleotide primer
  primer_bind (1)..(36)
  modified_base (1)..(1): base is a locked nucleic acid
  modified_base (4)..(4): base is a locked nucleic acid
  modified_base (15)..(15): base is a locked nucleic acid
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2382 - DNA, 35 bp, Artificial Sequence; identical to SEQ ID NO: 2340
  Pan degenerate oligonucleotide primer
  primer_bind (1)..(35)
  modified_base (1)..(1): base is a locked nucleic acid
  modified_base (5)..(5): base is a locked nucleic acid
  modified_base (11)..(11): base is a locked nucleic acid
  misc_feature (29)..(35): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2383 - DNA, 36 bp, Artificial Sequence; identical to SEQ ID NO: 2341
  Pan degenerate oligonucleotide primer
  primer_bind (1)..(36)
  modified_base (1)..(1): base is a locked nucleic acid
  modified_base (10)..(10): base is a locked nucleic acid
  modified_base (15)..(15): base is a locked nucleic acid
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2384 - DNA, 35 bp, Artificial Sequence; identical to SEQ ID NO: 2340
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2385 - DNA, 36 bp, Artificial Sequence; identical to SEQ ID NO: 2341
  Pan degenerate oligonucleotide primer
  primer_bind (1)..(36)
  modified_base (1)..(1): base is a locked nucleic acid
  modified_base (4)..(4): base is a locked nucleic acid
  modified_base (10)..(10): base is a locked nucleic acid
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2386 - DNA, 36 bp, Artificial Sequence; identical to SEQ ID NO: 2342
  Pan degenerate oligonucleotide primer
  primer_bind (1)..(36)
  modified_base (1)..(1): base is a locked nucleic acid
  modified_base (2)..(2): base is a locked nucleic acid
  modified_base (6)..(6): base is a locked nucleic acid
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2387 - DNA, 37 bp, Artificial Sequence; identical to SEQ ID NO: 2343
  Pan degenerate oligonucleotide primer
  primer_bind (1)..(37)
  modified_base (1)..(1): base is a locked nucleic acid
  modified_base (2)..(2): base is a locked nucleic acid
  modified_base (11)..(11): base is a locked nucleic acid
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2388 - DNA, 36 bp, Artificial Sequence; identical to SEQ ID NO: 2342
  Pan degenerate oligonucleotide primer
  primer_bind (1)..(36)
  modified_base (1)..(1): base is a locked nucleic acid
  modified_base (3)..(3): base is a locked nucleic acid
  modified_base (6)..(6): base is a locked nucleic acid
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2389 - DNA, 37 bp, Artificial Sequence; identical to SEQ ID NO: 2343
  Pan degenerate oligonucleotide primer
  primer_bind (1)..(37)
  modified_base (1)..(1): base is a locked nucleic acid
  modified_base (5)..(5): base is a locked nucleic acid
  modified_base (11)..(11): base is a locked nucleic acid
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2390 - DNA, 36 bp, Artificial Sequence; identical to SEQ ID NO: 2342
  Pan degenerate oligonucleotide primer
  primer_bind (1)..(36)
  modified_base (1)..(1): base is a locked nucleic acid
  modified_base (2)..(2): base is a locked nucleic acid
  modified_base (3)..(3): base is a locked nucleic acid
  misc_feature (30)..(36): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2391 - DNA, 37 bp, Artificial Sequence; identical to SEQ ID NO: 2343
  Pan degenerate oligonucleotide primer
  primer_bind (1)..(37)
  modified_base (1)..(1): base is a locked nucleic acid
  modified_base (2)..(2): base is a locked nucleic acid
  modified_base (5)..(5): base is a locked nucleic acid
  misc_feature (31)..(37): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2392 - DNA, 40 bp, Artificial Sequence; identical to SEQ ID NO: 2336
  Pan degenerate oligonucleotide primer
  primer_bind (1)..(40)
  modified_base (1)..(1): base is a locked nucleic acid
  modified_base (3)..(3): base is a locked nucleic acid
  modified_base (4)..(4): base is a locked nucleic acid
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2393 - DNA, 40 bp, Artificial Sequence; identical to SEQ ID NO: 2337
  Pan degenerate oligonucleotide primer
  primer_bind (1)..(40)
  modified_base (1)..(1): base is a locked nucleic acid
  modified_base (2)..(2): base is a locked nucleic acid
  modified_base (3)..(3): base is a locked nucleic acid
  misc_feature (34)..(40): Adaptor region of the pan degenerate antisense primer that adapts the probe-binding site downstream of codon 184 to correspond to the nucleotides in an oligonucleotide probe downstream of the discriminating single nucleotide polymorphism.

SEQ ID NO: 2394 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.
trtgytgyyctatytctaartcwgakcctaca

SEQ ID NO: 2395 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 188 to correspond to the nucleotides in an oligonucleotide probe downstream of the discriminating single nucleotide polymorphism.
tgytgyyctatytctaartcwgakcctacat

SEQ ID NO: 2396 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 188 to correspond to the nucleotides in an oligonucleotide probe downstream of the discriminating single nucleotide polymorphism.
ctrtgytgyyctatytctaartcwgakcctaca

SEQ ID NO: 2397 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.
rtgytgyyctatytctaartcwgakcctacat

SEQ ID NO: 2398 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.
ttttrytctrtgytgyyctatytctaartcwgakcctaca

SEQ ID NO: 2399 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.
tttrytctrtgytgyyctatytctaartcwgakcctacat

SEQ ID NO: 2400 - DNA, 26 bp, Artificial Sequence
  Pan degenerate oligonucleotide primer
  primer_bind (1)..(26)
  misc_feature (20)..(26): Adaptor region of the pan degenerate antisense primer that adapts the probe-binding site downstream of codon 188 to correspond to the nucleotides in an oligonucleotide probe downstream of the discriminating single nucleotide polymorphism.
gyyctatytctaartcwgakcctaca

SEQ ID NO: 2401 - DNA, 25 bp, Artificial Sequence
  Pan degenerate oligonucleotide primer
  primer_bind (1)..(25)
  misc_feature (19)..(25): Adaptor region of the pan degenerate antisense primer that adapts the probe-binding site downstream of codon 188 to correspond to the nucleotides in an oligonucleotide probe downstream of the discriminating single nucleotide polymorphism.
yctatytctaartcwgakcctacat

SEQ ID NO: 2402 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
gytgyyctatytctaartcwgakcctaca

SEQ ID NO: 2403 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 188 to correspond to the nucleotides in an oligonucleotide probe downstream of the discriminating single nucleotide polymorphism.
tgyyctatytctaartcwgakcctacat

SEQ ID NO: 2404 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 188 to correspond to the nucleotides in an oligonucleotide probe downstream of the discriminating single nucleotide polymorphism.
tgytgyyctatytctaartcwgakcctaca

SEQ ID NO: 2405 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
ytgyyctatytctaartcwgakcctacat

SEQ ID NO: 2406 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 188 to correspond to the nucleotides in an oligonucleotide probe downstream of the discriminating single nucleotide polymorphism.
yarytcytctayttttrytctrtgytgyyctatytctaartcagatcctac

SEQ ID NO: 2407 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
trtgytgyyctatytctaartcwgakcctacan

SEQ ID NO: 2408 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
tgytgyyctatytctaartcwgakcctacatn

SEQ ID NO: 2409 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
ctrtgytgyyctatytctaartcwgakcctacan

SEQ ID NO: 2410 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
rtgytgyyctatytctaartcwgakcctacatn

SEQ ID NO: 2411 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ttttrytctrtgytgyyctatytctaartcwgakcctacan

SEQ ID NO: 2412 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tttrytctrtgytgyyctatytctaartcwgakcctacatn

SEQ ID NO: 2413 - DNA, 27 bp, Artificial Sequence
  Pan degenerate oligonucleotide primer
  primer_bind (1)..(27)
  misc_feature (20)..(26): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (27)..(27): base is a locked nucleic acid
  misc_feature (27)..(27): n is a, c, g, or t
gyyctatytctaartcwgakcctacan

SEQ ID NO: 2414 - DNA, 26 bp, Artificial Sequence
  Pan degenerate oligonucleotide primer
  primer_bind (1)..(26)
  misc_feature (19)..(25): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (26)..(26): base is a locked nucleic acid
  misc_feature (26)..(26): n is a, c, g, or t
yctatytctaartcwgakcctacatn

SEQ ID NO: 2415 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
gytgyyctatytctaartcwgakcctacan

SEQ ID NO: 2416 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
tgyyctatytctaartcwgakcctacatn

SEQ ID NO: 2417 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tgytgyyctatytctaartcwgakcctacan

SEQ ID NO: 2418 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
ytgyyctatytctaartcwgakcctacatn

SEQ ID NO: 2419 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 188 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
yarytcytctayttttrytctrtgytgyyctatytctaartcagatcctacn

SEQ ID NO: 2420 - DNA, 32 bp, Artificial Sequence; identical to SEQ ID NO: 2394
  Pan degenerate oligonucleotide primer
  primer_bind (1)..(32)
  modified_base (1)..(1): base is a locked nucleic acid
  modified_base (3)..(3): base is a locked nucleic acid
  modified_base (7)..(7): base is a locked nucleic acid
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2421 - DNA, 31 bp, Artificial Sequence; identical to SEQ ID NO: 2395
  Pan degenerate oligonucleotide primer
  primer_bind (1)..(31)
  modified_base (1)..(1): base is a locked nucleic acid
  modified_base (3)..(3): base is a locked nucleic acid
  modified_base (7)..(7): base is a locked nucleic acid
  misc_feature (25)..(31): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2422 - DNA, 32 bp, Artificial Sequence; identical to SEQ ID NO: 2394
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2423 - DNA, 31 bp, Artificial Sequence; identical to SEQ ID NO: 2395
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2424 - DNA, 32 bp, Artificial Sequence; identical to SEQ ID NO: 2394
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2425 - DNA, 31 bp, Artificial Sequence; identical to SEQ ID NO: 2395
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2426 - DNA, 33 bp, Artificial Sequence; identical to SEQ ID NO: 2396
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2427 - DNA, 32 bp, Artificial Sequence; identical to SEQ ID NO: 2397
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2428 - DNA, 33 bp, Artificial Sequence; identical to SEQ ID NO: 2396
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2429 - DNA, 32 bp, Artificial Sequence; identical to SEQ ID NO: 2397
  Pan degenerate oligonucleotide primer
  primer_bind (1)..(32)
  modified_base (1)..(1): base is a locked nucleic acid
  modified_base (4)..(4): base is a locked nucleic acid
  modified_base (5)..(5): base is a locked nucleic acid
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2430 - DNA, 33 bp, Artificial Sequence; identical to SEQ ID NO: 2396
  Pan degenerate oligonucleotide primer
  primer_bind (1)..(33)
  modified_base (1)..(1): base is a locked nucleic acid
  modified_base (2)..(2): base is a locked nucleic acid
  modified_base (4)..(4): base is a locked nucleic acid
  misc_feature (27)..(33): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2431 - DNA, 32 bp, Artificial Sequence; identical to SEQ ID NO: 2397
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2432 - DNA, 40 bp, Artificial Sequence; identical to SEQ ID NO: 2398
  Pan degenerate oligonucleotide primer
  primer_bind (1)..(40)
  modified_base (3)..(3): base is a locked nucleic acid
  modified_base (8)..(8): base is a locked nucleic acid
  modified_base (11)..(11): base is a locked nucleic acid
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2433 - DNA, 40 bp, Artificial Sequence; identical to SEQ ID NO: 2399
  Pan degenerate oligonucleotide primer
  primer_bind (1)..(40)
  modified_base (4)..(4): base is a locked nucleic acid
  modified_base (9)..(9): base is a locked nucleic acid
  modified_base (12)..(12): base is a locked nucleic acid
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2434 - DNA, 40 bp, Artificial Sequence; identical to SEQ ID NO: 2398
  Pan degenerate oligonucleotide primer
  primer_bind (1)..(40)
  modified_base (3)..(3): base is a locked nucleic acid
  modified_base (9)..(9): base is a locked nucleic acid
  modified_base (11)..(11): base is a locked nucleic acid
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2435 - DNA, 40 bp, Artificial Sequence; identical to SEQ ID NO: 2399
  Pan degenerate oligonucleotide primer
  primer_bind (1)..(40)
  modified_base (4)..(4): base is a locked nucleic acid
  modified_base (10)..(10): base is a locked nucleic acid
  modified_base (12)..(12): base is a locked nucleic acid
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2436 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (16)..(16): base is a locked nucleic acid
  misc_feature (20)..(26): Adaptor region of the pan degenerate antisense primer that adapts the probe-binding site downstream of codon 188 to correspond to the nucleotides in an oligonucleotide probe downstream of the discriminating single nucleotide polymorphism.
gyyctatytctaartcwgakcctaca

SEQ ID NO: 2437 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (16)..(16): base is a locked nucleic acid
  misc_feature (19)..(25): Adaptor region of the pan degenerate antisense primer that adapts the probe-binding site downstream of codon 188 to correspond to the nucleotides in an oligonucleotide probe downstream of the discriminating single nucleotide polymorphism.
yctatytctaartcwgakcctacat

SEQ ID NO: 2438 - DNA, 26 bp, Artificial Sequence
  Pan degenerate oligonucleotide primer
  primer_bind (1)..(26)
  modified_base (1)..(1): base is a locked nucleic acid
  modified_base (15)..(15): base is a locked nucleic acid
  modified_base (16)..(16): base is a locked nucleic acid
  misc_feature (20)..(26): Adaptor region of the pan degenerate antisense primer that adapts the probe-binding site downstream of codon 188 to correspond to the nucleotides in an oligonucleotide probe downstream of the discriminating single nucleotide polymorphism.
gyyctatytctaartcwgakcctaca

SEQ ID NO: 2439 - DNA, 25 bp, Artificial Sequence
  Pan degenerate oligonucleotide primer
  primer_bind (1)..(25)
  modified_base (1)..(1): base is a locked nucleic acid
  modified_base (15)..(15): base is a locked nucleic acid
  modified_base (16)..(16): base is a locked nucleic acid
  misc_feature (19)..(25): Adaptor region of the pan degenerate antisense primer that adapts the probe-binding site downstream of codon 188 to correspond to the nucleotides in an oligonucleotide probe downstream of the discriminating single nucleotide polymorphism.
yctatytctaartcwgakcctacat

SEQ ID NO: 2440 - DNA, 26 bp, Artificial Sequence
  Pan degenerate oligonucleotide primer
  primer_bind (1)..(26)
  modified_base (1)..(1): base is a locked nucleic acid
  modified_base (4)..(4): base is a locked nucleic acid
  modified_base (15)..(15): base is a locked nucleic acid
  misc_feature (20)..(26): Adaptor region of the pan degenerate antisense primer that adapts the probe-binding site downstream of codon 188 to correspond to the nucleotides in an oligonucleotide probe downstream of the discriminating single nucleotide polymorphism.
gyyctatytctaartcwgakcctaca

SEQ ID NO: 2441 - DNA, 25 bp, Artificial Sequence
  Pan degenerate oligonucleotide primer
  primer_bind (1)..(25)
  modified_base (1)..(1): base is a locked nucleic acid
  modified_base (4)..(4): base is a locked nucleic acid
  modified_base (15)..(15): base is a locked nucleic acid
  misc_feature (19)..(25): Adaptor region of the pan degenerate antisense primer that adapts the probe-binding site downstream of codon 188 to correspond to the nucleotides in an oligonucleotide probe downstream of the discriminating single nucleotide polymorphism.
yctatytctaartcwgakcctacat

SEQ ID NO: 2442 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (18)..(18): base is a locked nucleic acid
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
gytgyyctatytctaartcwgakcctaca

SEQ ID NO: 2443 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (18)..(18): base is a locked nucleic acid
  misc_feature (22)..(28): Adaptor region of the pan degenerate antisense primer that adapts the probe-binding site downstream of codon 188 to correspond to the nucleotides in an oligonucleotide probe downstream of the discriminating single nucleotide polymorphism.
tgyyctatytctaartcwgakcctacat

SEQ ID NO: 2444 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (18)..(18): base is a locked nucleic acid
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
gytgyyctatytctaartcwgakcctaca

SEQ ID NO: 2445 - DNA, 28 bp, Artificial Sequence
  Pan degenerate oligonucleotide primer
  primer_bind (1)..(28)
  modified_base (1)..(1): base is a locked nucleic acid
  modified_base (7)..(7): base is a locked nucleic acid
  modified_base (18)..(18): base is a locked nucleic acid
  misc_feature (22)..(28): Adaptor region of the pan degenerate antisense primer that adapts the probe-binding site downstream of codon 188 to correspond to the nucleotides in an oligonucleotide probe downstream of the discriminating single nucleotide polymorphism.
tgyyctatytctaartcwgakcctacat

SEQ ID NO: 2446 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (7)..(7): base is a locked nucleic acid
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
gytgyyctatytctaartcwgakcctaca

SEQ ID NO: 2447 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (7)..(7): base is a locked nucleic acid
  misc_feature (22)..(28): Adaptor region of the pan degenerate antisense primer that adapts the probe-binding site downstream of codon 188 to correspond to the nucleotides in an oligonucleotide probe downstream of the discriminating single nucleotide polymorphism.
tgyyctatytctaartcwgakcctacat

SEQ ID NO: 2448 - DNA, 30 bp, Artificial Sequence; identical to SEQ ID NO: 2404
  Pan degenerate oligonucleotide primer
  primer_bind (1)..(30)
  modified_base (1)..(1): base is a locked nucleic acid
  modified_base (2)..(2): base is a locked nucleic acid
  modified_base (8)..(8): base is a locked nucleic acid
  misc_feature (24)..(30): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2449 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (8)..(8): base is a locked nucleic acid
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
ytgyyctatytctaartcwgakcctacat

SEQ ID NO: 2450 - DNA, 30 bp, Artificial Sequence; identical to SEQ ID NO: 2404
  Pan degenerate oligonucleotide primer
  primer_bind (1)..(30)
  modified_base (1)..(1): base is a locked nucleic acid
  modified_base (5)..(5): base is a locked nucleic acid
  modified_base (8)..(8): base is a locked nucleic acid
  misc_feature (24)..(30): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2451 - DNA, 29 bp, Artificial Sequence
  Pan degenerate oligonucleotide primer
  primer_bind (1)..(29)
  modified_base (1)..(1): base is a locked nucleic acid
  modified_base (5)..(5): base is a locked nucleic acid
  modified_base (8)..(8): base is a locked nucleic acid
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
ytgyyctatytctaartcwgakcctacat

SEQ ID NO: 2452 - DNA, 30 bp, Artificial Sequence; identical to SEQ ID NO: 2404
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2453 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 188 to correspond to the nucleotides in an oligonucleotide probe downstream of the discriminating single nucleotide polymorphism.
ytgyyctatytctaartcwgakcctacat

SEQ ID NO: 2454 - DNA, 40 bp, Artificial Sequence; identical to SEQ ID NO: 2398
  Pan degenerate oligonucleotide primer
  primer_bind (1)..(40)
  modified_base (3)..(3): base is a locked nucleic acid
  modified_base (8)..(8): base is a locked nucleic acid
  modified_base (9)..(9): base is a locked nucleic acid
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2455 - DNA, 40 bp, Artificial Sequence; identical to SEQ ID NO: 2399
  Pan degenerate oligonucleotide primer
  primer_bind (1)..(40)
  modified_base (4)..(4): base is a locked nucleic acid
  modified_base (9)..(9): base is a locked nucleic acid
  modified_base (10)..(10): base is a locked nucleic acid
  misc_feature (34)..(40): Adaptor region of the pan degenerate antisense primer that adapts the probe-binding site downstream of codon 188 to correspond to the nucleotides in an oligonucleotide probe downstream of the discriminating single nucleotide polymorphism.

SEQ ID NO: 2456 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 190 to correspond to the nucleotides in an oligonucleotide probe downstream of the discriminating single nucleotide polymorphism.
ayttttrytctrtgytgyyctatytctaartcwgak

SEQ ID NO: 2457 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.
ttttrytctrtgytgyyctatytctaartcwgakc

SEQ ID NO: 2458 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 190 to correspond to the nucleotides in an oligonucleotide probe downstream of the discriminating single nucleotide polymorphism.
ctayttttrytctrtgytgyyctatytctaartcwgak

SEQ ID NO: 2459 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 190 to correspond to the nucleotides in an oligonucleotide probe downstream of the discriminating single nucleotide polymorphism.
ayttttrytctrtgytgyyctatytctaartcwgakc

SEQ ID NO: 2460 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.
ytctayttttrytctrtgytgyyctatytctaartcwgak

SEQ ID NO: 2461 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.
tctayttttrytctrtgytgyyctatytctaartcwgakc

SEQ ID NO: 2462 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 190 to correspond to the nucleotides in an oligonucleotide probe downstream of the discriminating single nucleotide polymorphism.
ytctrtgytgyyctatytctaartcwgak

SEQ ID NO: 2463 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 190 to correspond to the nucleotides in an oligonucleotide probe downstream of the discriminating single nucleotide polymorphism.
ctrtgytgyyctatytctaartcwgakc

SEQ ID NO: 2464 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 190 to correspond to the nucleotides in an oligonucleotide probe downstream of the discriminating single nucleotide polymorphism.
ttrytctrtgytgyyctatytctaartcwgak

SEQ ID NO: 2465 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 190 to correspond to the nucleotides in an oligonucleotide probe downstream of the discriminating single nucleotide polymorphism.
rytctrtgytgyyctatytctaartcwgakc

SEQ ID NO: 2466 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.
yttttrytctrtgytgyyctatytctaartcwgak

SEQ ID NO: 2467 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 190 to correspond to the nucleotides in an oligonucleotide probe downstream of the discriminating single nucleotide polymorphism.
tttrytctrtgytgyyctatytctaartcwgakc

SEQ ID NO: 2468 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 190 to correspond to the nucleotides in an oligonucleotide probe downstream of the discriminating single nucleotide polymorphism.
hkbyctyarytcytctayttttrytctrtgytgyyctatytctaagtcaga

SEQ ID NO: 2469 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
ayttttrytctrtgytgyyctatytctaartcwgakn

SEQ ID NO: 2470 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ttttrytctrtgytgyyctatytctaartcwgakcn

SEQ ID NO: 2471 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ctayttttrytctrtgytgyyctatytctaartcwgakn

SEQ ID NO: 2472 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ayttttrytctrtgytgyyctatytctaartcwgakcn

SEQ ID NO: 2473 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ytctayttttrytctrtgytgyyctatytctaartcwgakn

SEQ ID NO: 2474 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tctayttttrytctrtgytgyyctatytctaartcwgakcn

SEQ ID NO: 2475 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
ytctrtgytgyyctatytctaartcwgakn

SEQ ID NO: 2476 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
ctrtgytgyyctatytctaartcwgakcn

SEQ ID NO: 2477 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ttrytctrtgytgyyctatytctaartcwgakn

SEQ ID NO: 2478 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
rytctrtgytgyyctatytctaartcwgakcn

SEQ ID NO: 2479 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
yttttrytctrtgytgyyctatytctaartcwgakn

SEQ ID NO: 2480 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
tttrytctrtgytgyyctatytctaartcwgakcn

SEQ ID NO: 2481 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 190 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
hkbyctyarytcytctayttttrytctrtgytgyyctatytctaagtcagan

SEQ ID NO: 2482 - DNA, 36 bp, Artificial Sequence; identical to SEQ ID NO: 2456
  Pan degenerate oligonucleotide primer
  primer_bind (1)..(36)
  modified_base (1)..(1): base is a locked nucleic acid
  modified_base (2)..(2): base is a locked nucleic acid
  modified_base (8)..(8): base is a locked nucleic acid
  misc_feature (30)..(36): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2483 - DNA, 35 bp, Artificial Sequence; identical to SEQ ID NO: 2457
  Pan degenerate oligonucleotide primer
  primer_bind (1)..(35)
  modified_base (1)..(1): base is a locked nucleic acid
  modified_base (2)..(2): base is a locked nucleic acid
  modified_base (8)..(8): base is a locked nucleic acid
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2484 - DNA, 36 bp, Artificial Sequence; identical to SEQ ID NO: 2456
  Pan degenerate oligonucleotide primer
  primer_bind (1)..(36)
  modified_base (1)..(1): base is a locked nucleic acid
  modified_base (5)..(5): base is a locked nucleic acid
  modified_base (8)..(8): base is a locked nucleic acid
  misc_feature (30)..(36): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2485 - DNA, 35 bp, Artificial Sequence; identical to SEQ ID NO: 2457
  Pan degenerate oligonucleotide primer
  primer_bind (1)..(35)
  modified_base (1)..(1): base is a locked nucleic acid
  modified_base (5)..(5): base is a locked nucleic acid
  modified_base (8)..(8): base is a locked nucleic acid
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2486 - DNA, 36 bp, Artificial Sequence; identical to SEQ ID NO: 2456
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2487 - DNA, 35 bp, Artificial Sequence; identical to SEQ ID NO: 2457
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2488 - DNA, 38 bp, Artificial Sequence; identical to SEQ ID NO: 2458
  Pan degenerate oligonucleotide primer
  primer_bind (1)..(38)
  modified_base (1)..(1): base is a locked nucleic acid
  modified_base (3)..(3): base is a locked nucleic acid
  modified_base (7)..(7): base is a locked nucleic acid
  misc_feature (32)..(38): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2489 - DNA, 37 bp, Artificial Sequence; identical to SEQ ID NO: 2459
  Pan degenerate oligonucleotide primer
  primer_bind (1)..(37)
  modified_base (1)..(1): base is a locked nucleic acid
  modified_base (3)..(3): base is a locked nucleic acid
  modified_base (7)..(7): base is a locked nucleic acid
  misc_feature (31)..(37): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2490 - DNA, 38 bp, Artificial Sequence; identical to SEQ ID NO: 2458
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2491 - DNA, 37 bp, Artificial Sequence; identical to SEQ ID NO: 2459
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2492 - DNA, 38 bp, Artificial Sequence; identical to SEQ ID NO: 2458
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2493 - DNA, 37 bp, Artificial Sequence; identical to SEQ ID NO: 2459
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2494 - DNA, 40 bp, Artificial Sequence; identical to SEQ ID NO: 2460
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2495 - DNA, 40 bp, Artificial Sequence; identical to SEQ ID NO: 2461
  Pan degenerate oligonucleotide primer
  primer_bind (1)..(40)
  modified_base (3)..(3): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2496 - DNA, 40 bp, Artificial Sequence; identical to SEQ ID NO: 2460
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2497 - DNA, 40 bp, Artificial Sequence; identical to SEQ ID NO: 2461
  Pan degenerate oligonucleotide primer
  primer_bind (1)..(40)
  modified_base (3)..(3): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2498 - DNA, 29 bp, Artificial Sequence
  Pan degenerate oligonucleotide primer
  primer_bind (1)..(29)
  modified_base (1)..(1): base is a locked nucleic acid
  modified_base (12)..(12): base is a locked nucleic acid
  modified_base (15)..(15): base is a locked nucleic acid
  misc_feature (23)..(29): Adaptor region of the pan degenerate antisense primer that adapts the probe-binding site downstream of codon 190 to correspond to the nucleotides in an oligonucleotide probe downstream of the discriminating single nucleotide polymorphism.
ytctrtgytgyyctatytctaartcwgak

SEQ ID NO: 2499 - DNA, 28 bp, Artificial Sequence
  Pan degenerate oligonucleotide primer
  primer_bind (1)..(28)
  modified_base (1)..(1): base is a locked nucleic acid
  modified_base (12)..(12): base is a locked nucleic acid
  modified_base (15)..(15): base is a locked nucleic acid
  misc_feature (22)..(28): Adaptor region of the pan degenerate antisense primer that adapts the probe-binding site downstream of codon 190 to correspond to the nucleotides in an oligonucleotide probe downstream of the discriminating single nucleotide polymorphism.
ctrtgytgyyctatytctaartcwgakc

SEQ ID NO: 2500 - DNA, 29 bp, Artificial Sequence
  Pan degenerate oligonucleotide primer
  primer_bind (1)..(29)
  modified_base (1)..(1): base is a locked nucleic acid
  modified_base (13)..(13): base is a locked nucleic acid
  modified_base (15)..(15): base is a locked nucleic acid
  misc_feature (23)..(29): Adaptor region of the pan degenerate antisense primer that adapts the probe-binding site downstream of codon 190 to correspond to the nucleotides in an oligonucleotide probe downstream of the discriminating single nucleotide polymorphism.
ytctrtgytgyyctatytctaartcwgak

SEQ ID NO: 2501 - DNA, 28 bp, Artificial Sequence
  Pan degenerate oligonucleotide primer
  primer_bind (1)..(28)
  modified_base (1)..(1): base is a locked nucleic acid
  modified_base (13)..(13): base is a locked nucleic acid
  modified_base (15)..(15): base is a locked nucleic acid
  misc_feature (22)..(28): Adaptor region of the pan degenerate antisense primer that adapts the probe-binding site downstream of codon 190 to correspond to the nucleotides in an oligonucleotide probe downstream of the discriminating single nucleotide polymorphism.
ctrtgytgyyctatytctaartcwgakc

SEQ ID NO: 2502 - DNA, 29 bp, Artificial Sequence
  Pan degenerate oligonucleotide primer
  primer_bind (1)..(29)
  modified_base (1)..(1): base is a locked nucleic acid
  modified_base (12)..(12): base is a locked nucleic acid
  modified_base (13)..(13): base is a locked nucleic acid
  misc_feature (23)..(29): Adaptor region of the pan degenerate antisense primer that adapts the probe-binding site downstream of codon 190 to correspond to the nucleotides in an oligonucleotide probe downstream of the discriminating single nucleotide polymorphism.
ytctrtgytgyyctatytctaartcwgak

SEQ ID NO: 2503 - DNA, 28 bp, Artificial Sequence
  Pan degenerate oligonucleotide primer
  primer_bind (1)..(28)
  modified_base (1)..(1): base is a locked nucleic acid
  modified_base (12)..(12): base is a locked nucleic acid
  modified_base (13)..(13): base is a locked nucleic acid
  misc_feature (22)..(28): Adaptor region of the pan degenerate antisense primer that adapts the probe-binding site downstream of codon 190 to correspond to the nucleotides in an oligonucleotide probe downstream of the discriminating single nucleotide polymorphism.
ctrtgytgyyctatytctaartcwgakc

SEQ ID NO: 2504 - DNA, 32 bp, Artificial Sequence; identical to SEQ ID NO: 2464
  Pan degenerate oligonucleotide primer
  primer_bind (1)..(32)
  modified_base (1)..(1): base is a locked nucleic acid
  modified_base (4)..(4): base is a locked nucleic acid
  modified_base (16)..(16): base is a locked nucleic acid
  misc_feature (26)..(32): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2505 - DNA, 31 bp, Artificial Sequence; identical to SEQ ID NO: 2465
  Pan degenerate oligonucleotide primer
  primer_bind (1)..(31)
  modified_base (1)..(1): base is a locked nucleic acid
  modified_base (4)..(4): base is a locked nucleic acid
  modified_base (16)..(16): base is a locked nucleic acid
  misc_feature (25)..(31): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2506 - DNA, 32 bp, Artificial Sequence; identical to SEQ ID NO: 2464
  Pan degenerate oligonucleotide primer
  primer_bind (1)..(32)
  modified_base (1)..(1): base is a locked nucleic acid
  modified_base (15)..(15): base is a locked nucleic acid
  modified_base (16)..(16): base is a locked nucleic acid
  misc_feature (26)..(32): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2507 - DNA, 31 bp, Artificial Sequence; identical to SEQ ID NO: 2465
  Pan degenerate oligonucleotide primer
  primer_bind (1)..(31)
  modified_base (1)..(1): base is a locked nucleic acid
  modified_base (15)..(15): base is a locked nucleic acid
  modified_base (16)..(16): base is a locked nucleic acid
  misc_feature (25)..(31): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2508 - DNA, 32 bp, Artificial Sequence; identical to SEQ ID NO: 2464
  Pan degenerate oligonucleotide primer
  primer_bind (1)..(32)
  modified_base (1)..(1): base is a locked nucleic acid
  modified_base (4)..(4): base is a locked nucleic acid
  modified_base (15)..(15): base is a locked nucleic acid
  misc_feature (26)..(32): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2509 - DNA, 31 bp, Artificial Sequence; identical to SEQ ID NO: 2465
  Pan degenerate oligonucleotide primer
  primer_bind (1)..(31)
  modified_base (1)..(1): base is a locked nucleic acid
  modified_base (4)..(4): base is a locked nucleic acid
  modified_base (15)..(15): base is a locked nucleic acid
  misc_feature (25)..(31): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2510 - DNA, 35 bp, Artificial Sequence; identical to SEQ ID NO: 2466
  Pan degenerate oligonucleotide primer
  primer_bind (1)..(35)
  modified_base (1)..(1): base is a locked nucleic acid
  modified_base (4)..(4): base is a locked nucleic acid
  modified_base (18)..(18): base is a locked nucleic acid
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2511 - DNA, 34 bp, Artificial Sequence; identical to SEQ ID NO: 2467
  Pan degenerate oligonucleotide primer
  primer_bind (1)..(34)
  modified_base (1)..(1): base is a locked nucleic acid
  modified_base (4)..(4): base is a locked nucleic acid
  modified_base (18)..(18): base is a locked nucleic acid
  misc_feature (28)..(34): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2512 - DNA, 35 bp, Artificial Sequence; identical to SEQ ID NO: 2466
  Pan degenerate oligonucleotide primer
  primer_bind (1)..(35)
  modified_base (1)..(1): base is a locked nucleic acid
  modified_base (7)..(7): base is a locked nucleic acid
  modified_base (18)..(18): base is a locked nucleic acid
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2513 - DNA, 34 bp, Artificial Sequence; identical to SEQ ID NO: 2467
  Pan degenerate oligonucleotide primer
  primer_bind (1)..(34)
  modified_base (1)..(1): base is a locked nucleic acid
  modified_base (7)..(7): base is a locked nucleic acid
  modified_base (18)..(18): base is a locked nucleic acid
  misc_feature (28)..(34): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2514 - DNA, 35 bp, Artificial Sequence; identical to SEQ ID NO: 2466
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2515 - DNA, 34 bp, Artificial Sequence; identical to SEQ ID NO: 2467
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2516 - DNA, 40 bp, Artificial Sequence; identical to SEQ ID NO: 2460
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2517 - DNA, 40 bp, Artificial Sequence; identical to SEQ ID NO: 2461
  Pan degenerate oligonucleotide primer
  primer_bind (1)..(40)
  modified_base (3)..(3): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 190 to correspond to the nucleotides in an oligonucleotide probe downstream of the discriminating single nucleotide polymorphism.

SEQ ID NO: 2518 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 210 to correspond to the nucleotides in an oligonucleotide probe downstream of the discriminating single nucleotide polymorphism.
atgyttyttrtctggtgtrgwraryccccabyty

SEQ ID NO: 2519 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 210 to correspond to the nucleotides in an oligonucleotide probe downstream of the discriminating single nucleotide polymorphism.
gatgyttyttrtctggtgtrgwraryccccabyty

SEQ ID NO: 2520 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 210 to correspond to the nucleotides in an oligonucleotide probe downstream of the discriminating single nucleotide polymorphism.
yttytgatgyttyttrtctggtgtrgwraryccccabyty

SEQ ID NO: 2521 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 210 to correspond to the nucleotides in an oligonucleotide probe downstream of the discriminating single nucleotide polymorphism.
tyttrtctggtgtrgwraryccccabyty

SEQ ID NO: 2522 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 210 to correspond to the nucleotides in an oligonucleotide probe downstream of the discriminating single nucleotide polymorphism.
gyttyttrtctggtgtrgwraryccccabyty

SEQ ID NO: 2523 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 210 to correspond to the nucleotides in an oligonucleotide probe downstream of the discriminating single nucleotide polymorphism.
tgyttyttrtctggtgtrgwraryccccabyty

SEQ ID NO: 2524 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 210 to correspond to the nucleotides in an oligonucleotide probe downstream of the discriminating single nucleotide polymorphism.
raatggrggttcyttytgatgyttyttrtctggkgtrkwraryccccacct

SEQ ID NO: 2525 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 210 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
atgyttyttrtctggtgtrgwraryccccabytyn

SEQ ID NO: 2526 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 210 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
gatgyttyttrtctggtgtrgwraryccccabytyn

SEQ ID NO: 2527 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 210 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yttytgatgyttyttrtctggtgtrgwraryccccabytyn

SEQ ID NO: 2528 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 210 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
tyttrtctggtgtrgwraryccccabytyn

SEQ ID NO: 2529 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 210 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
gyttyttrtctggtgtrgwraryccccabytyn

SEQ ID NO: 2530 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 210 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tgyttyttrtctggtgtrgwraryccccabytyn

SEQ ID NO: 2531 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 210 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
raatggrggttcyttytgatgyttyttrtctggkgtrkwraryccccacctn

SEQ ID NO: 2532 - DNA, 34 bp, Artificial Sequence; identical to SEQ ID NO: 2518
  Pan degenerate oligonucleotide primer
  primer_bind (1)..(34)
  modified_base (1)..(1): base is a locked nucleic acid
  modified_base (2)..(2): base is a locked nucleic acid
  modified_base (6)..(6): base is a locked nucleic acid
  misc_feature (28)..(34): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2533 - DNA, 34 bp, Artificial Sequence; identical to SEQ ID NO: 2518
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2534 - DNA, 34 bp, Artificial Sequence; identical to SEQ ID NO: 2518
  Pan degenerate oligonucleotide primer
  primer_bind (1)..(34)
  modified_base (1)..(1): base is a locked nucleic acid
  modified_base (2)..(2): base is a locked nucleic acid
  modified_base (3)..(3): base is a locked nucleic acid
  misc_feature (28)..(34): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2535 - DNA, 35 bp, Artificial Sequence; identical to SEQ ID NO: 2519
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2536 - DNA, 35 bp, Artificial Sequence; identical to SEQ ID NO: 2519
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2537 - DNA, 35 bp, Artificial Sequence; identical to SEQ ID NO: 2519
  Pan degenerate oligonucleotide primer
  primer_bind (1)..(35)
  modified_base (1)..(1): base is a locked nucleic acid
  modified_base (2)..(2): base is a locked nucleic acid
  modified_base (3)..(3): base is a locked nucleic acid
  misc_feature (29)..(35): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2538 - DNA, 40 bp, Artificial Sequence; identical to SEQ ID NO: 2520
  Pan degenerate oligonucleotide primer
  primer_bind (1)..(40)
  modified_base (5)..(5): base is a locked nucleic acid
  modified_base (6)..(6): base is a locked nucleic acid
  modified_base (8)..(8): base is a locked nucleic acid
  misc_feature (34)..(40): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2539 - DNA, 40 bp, Artificial Sequence; identical to SEQ ID NO: 2520
  Pan degenerate oligonucleotide primer
  primer_bind (1)..(40)
  modified_base (5)..(5): base is a locked nucleic acid
  modified_base (7)..(7): base is a locked nucleic acid
  modified_base (8)..(8): base is a locked nucleic acid
  misc_feature (34)..(40): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2540 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (9)..(9): base is a locked nucleic acid
  misc_feature (23)..(29): Adaptor region of the pan degenerate antisense primer that adapts the probe-binding site downstream of codon 210 to correspond to the nucleotides in an oligonucleotide probe downstream of the discriminating single nucleotide polymorphism.
tyttrtctggtgtrgwraryccccabyty

SEQ ID NO: 2541 - DNA, 29 bp, Artificial Sequence
  Pan degenerate oligonucleotide primer
  primer_bind (1)..(29)
  modified_base (1)..(1): base is a locked nucleic acid
  modified_base (7)..(7): base is a locked nucleic acid
  modified_base (9)..(9): base is a locked nucleic acid
  misc_feature (23)..(29): Adaptor region of the pan degenerate antisense primer that adapts the probe-binding site downstream of codon 210 to correspond to the nucleotides in an oligonucleotide probe downstream of the discriminating single nucleotide polymorphism.
tyttrtctggtgtrgwraryccccabyty

SEQ ID NO: 2542 - DNA, 29 bp, Artificial Sequence
  Pan degenerate oligonucleotide primer
  primer_bind (1)..(29)
  modified_base (1)..(1): base is a locked nucleic acid
  modified_base (6)..(6): base is a locked nucleic acid
  modified_base (7)..(7): base is a locked nucleic acid
  misc_feature (23)..(29): Adaptor region of the pan degenerate antisense primer that adapts the probe-binding site downstream of codon 210 to correspond to the nucleotides in an oligonucleotide probe downstream of the discriminating single nucleotide polymorphism.
tyttrtctggtgtrgwraryccccabyty

SEQ ID NO: 2543 - DNA, 32 bp, Artificial Sequence; identical to SEQ ID NO: 2522
  Pan degenerate oligonucleotide primer
  primer_bind (1)..(32)
  modified_base (1)..(1): base is a locked nucleic acid
  modified_base (4)..(4): base is a locked nucleic acid
  modified_base (10)..(10): base is a locked nucleic acid
  misc_feature (26)..(32): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2544 - DNA, 32 bp, Artificial Sequence; identical to SEQ ID NO: 2522
  Pan degenerate oligonucleotide primer
  primer_bind (1)..(32)
  modified_base (1)..(1): base is a locked nucleic acid
  modified_base (9)..(9): base is a locked nucleic acid
  modified_base (10)..(10): base is a locked nucleic acid
  misc_feature (26)..(32): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2545 - DNA, 32 bp, Artificial Sequence; identical to SEQ ID NO: 2522
  Pan degenerate oligonucleotide primer
  primer_bind (1)..(32)
  modified_base (1)..(1): base is a locked nucleic acid
  modified_base (4)..(4): base is a locked nucleic acid
  modified_base (9)..(9): base is a locked nucleic acid
  misc_feature (26)..(32): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2546 - DNA, 33 bp, Artificial Sequence; identical to SEQ ID NO: 2523
  Pan degenerate oligonucleotide primer
  primer_bind (1)..(33)
  modified_base (1)..(1): base is a locked nucleic acid
  modified_base (2)..(2): base is a locked nucleic acid
  modified_base (10)..(10): base is a locked nucleic acid
  misc_feature (27)..(33): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2547 - DNA, 33 bp, Artificial Sequence; identical to SEQ ID NO: 2523
  Pan degenerate oligonucleotide primer
  primer_bind (1)..(33)
  modified_base (1)..(1): base is a locked nucleic acid
  modified_base (5)..(5): base is a locked nucleic acid
  modified_base (10)..(10): base is a locked nucleic acid
  misc_feature (27)..(33): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2548 - DNA, 33 bp, Artificial Sequence; identical to SEQ ID NO: 2523
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2549 - DNA, 40 bp, Artificial Sequence; identical to SEQ ID NO: 2520
  Pan degenerate oligonucleotide primer
  primer_bind (1)..(40)
  modified_base (5)..(5): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 210 to correspond to the nucleotides in an oligonucleotide probe downstream of the discriminating single nucleotide polymorphism.

SEQ ID NO: 2550 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 215 to correspond to the nucleotides in an oligonucleotide probe downstream of the discriminating single nucleotide polymorphism.
aatggrggttcyttytgatgyttyttrtctggtgtr

SEQ ID NO: 2551 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 215 to correspond to the nucleotides in an oligonucleotide probe downstream of the discriminating single nucleotide polymorphism.
graatggrggttcyttytgatgyttyttrtctggtgtr

SEQ ID NO: 2552 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 215 to correspond to the nucleotides in an oligonucleotide probe downstream of the discriminating single nucleotide polymorphism.
aagraatggrggttcyttytgatgyttyttrtctggtgtr

SEQ ID NO: 2553 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 215 to correspond to the nucleotides in an oligonucleotide probe downstream of the discriminating single nucleotide polymorphism.
grggttcyttytgatgyttyttrtctggtgtr

SEQ ID NO: 2554 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 215 to correspond to the nucleotides in an oligonucleotide probe downstream of the discriminating single nucleotide polymorphism.
ggrggttcyttytgatgyttyttrtctggtgtr

SEQ ID NO: 2555 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 215 to correspond to the nucleotides in an oligonucleotide probe downstream of the discriminating single nucleotide polymorphism.
atggrggttcyttytgatgyttyttrtctggtgtr

SEQ ID NO: 2556 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 215 to correspond to the nucleotides in an oligonucleotide probe downstream of the discriminating single nucleotide polymorphism.
atahcccatccaragraatggrggttcyttytgatgyttyttrtctggtgt

SEQ ID NO: 2557 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 215 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
aatggrggttcyttytgatgyttyttrtctggtgtrn

SEQ ID NO: 2558 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 215 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
graatggrggttcyttytgatgyttyttrtctggtgtrn

SEQ ID NO: 2559 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 215 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
aagraatggrggttcyttytgatgyttyttrtctggtgtrn

SEQ ID NO: 2560 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 215 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
grggttcyttytgatgyttyttrtctggtgtrn

SEQ ID NO: 2561 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 215 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
ggrggttcyttytgatgyttyttrtctggtgtrn

SEQ ID NO: 2562 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 215 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
atggrggttcyttytgatgyttyttrtctggtgtrn

SEQ ID NO: 2563 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 215 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
atahcccatccaragraatggrggttcyttytgatgyttyttrtctggtgtn

SEQ ID NO: 2564 - DNA, 36 bp, Artificial Sequence; identical to SEQ ID NO: 2550
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2565 - DNA, 36 bp, Artificial Sequence; identical to SEQ ID NO: 2550
  Pan degenerate oligonucleotide primer
  primer_bind (1)..(36)
  modified_base (1)..(1): base is a locked nucleic acid
  modified_base (4)..(4): base is a locked nucleic acid
  modified_base (5)..(5): base is a locked nucleic acid
  misc_feature (30)..(36): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2566 - DNA, 36 bp, Artificial Sequence; identical to SEQ ID NO: 2550
  Pan degenerate oligonucleotide primer
  primer_bind (1)..(36)
  modified_base (1)..(1): base is a locked nucleic acid
  modified_base (2)..(2): base is a locked nucleic acid
  modified_base (4)..(4): base is a locked nucleic acid
  misc_feature (30)..(36): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2567 - DNA, 38 bp, Artificial Sequence; identical to SEQ ID NO: 2551
  Pan degenerate oligonucleotide primer
  primer_bind (1)..(38)
  modified_base (1)..(1): base is a locked nucleic acid
  modified_base (3)..(3): base is a locked nucleic acid
  modified_base (6)..(6): base is a locked nucleic acid
  misc_feature (32)..(38): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2568 - DNA, 38 bp, Artificial Sequence; identical to SEQ ID NO: 2551
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2569 - DNA, 38 bp, Artificial Sequence; identical to SEQ ID NO: 2551
  Pan degenerate oligonucleotide primer
  primer_bind (1)..(38)
  modified_base (1)..(1): base is a locked nucleic acid
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2570 - DNA, 40 bp, Artificial Sequence; identical to SEQ ID NO: 2552
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2571 - DNA, 40 bp, Artificial Sequence; identical to SEQ ID NO: 2552
  Pan degenerate oligonucleotide primer
  primer_bind (1)..(40)
  modified_base (2)..(2): base is a locked nucleic acid
  modified_base (5)..(5): base is a locked nucleic acid
  modified_base (6)..(6): base is a locked nucleic acid
  misc_feature (34)..(40): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2572 - DNA, 32 bp, Artificial Sequence; identical to SEQ ID NO: 2553
  Pan degenerate oligonucleotide primer
  primer_bind (1)..(32)
  modified_base (1)..(1): base is a locked nucleic acid
  modified_base (6)..(6): base is a locked nucleic acid
  modified_base (10)..(10): base is a locked nucleic acid
  misc_feature (26)..(32): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2573 - DNA, 32 bp, Artificial Sequence; identical to SEQ ID NO: 2553
  Pan degenerate oligonucleotide primer
  primer_bind (1)..(32)
  modified_base (1)..(1): base is a locked nucleic acid
  modified_base (7)..(7): base is a locked nucleic acid
  modified_base (10)..(10): base is a locked nucleic acid
  misc_feature (26)..(32): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2574 - DNA, 32 bp, Artificial Sequence; identical to SEQ ID NO: 2553
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2575 - DNA, 33 bp, Artificial Sequence; identical to SEQ ID NO: 2554
  Pan degenerate oligonucleotide primer
  primer_bind (1)..(33)
  modified_base (1)..(1): base is a locked nucleic acid
  modified_base (2)..(2): base is a locked nucleic acid
  modified_base (8)..(8): base is a locked nucleic acid
  misc_feature (27)..(33): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2576 - DNA, 33 bp, Artificial Sequence; identical to SEQ ID NO: 2554
  Pan degenerate oligonucleotide primer
  primer_bind (1)..(33)
  modified_base (1)..(1): base is a locked nucleic acid
  modified_base (7)..(7): base is a locked nucleic acid
  modified_base (8)..(8): base is a locked nucleic acid
  misc_feature (27)..(33): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2577 - DNA, 33 bp, Artificial Sequence; identical to SEQ ID NO: 2554
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2578 - DNA, 35 bp, Artificial Sequence; identical to SEQ ID NO: 2555
  Pan degenerate oligonucleotide primer
  primer_bind (1)..(35)
  modified_base (1)..(1): base is a locked nucleic acid
  modified_base (3)..(3): base is a locked nucleic acid
  modified_base (9)..(9): base is a locked nucleic acid
  misc_feature (29)..(35): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2579 - DNA, 35 bp, Artificial Sequence; identical to SEQ ID NO: 2555
  Pan degenerate oligonucleotide primer
  primer_bind (1)..(35)
  modified_base (1)..(1): base is a locked nucleic acid
  modified_base (4)..(4): base is a locked nucleic acid
  modified_base (9)..(9): base is a locked nucleic acid
  misc_feature (29)..(35): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2580 - DNA, 35 bp, Artificial Sequence; identical to SEQ ID NO: 2555
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2581 - DNA, 40 bp, Artificial Sequence; identical to SEQ ID NO: 2552
  Pan degenerate oligonucleotide primer
  primer_bind (1)..(40)
  modified_base (2)..(2): base is a locked nucleic acid
  modified_base (3)..(3): base is a locked nucleic acid
  modified_base (5)..(5): base is a locked nucleic acid
  misc_feature (34)..(40): Adaptor region of the pan degenerate antisense primer that adapts the probe-binding site downstream of codon 215 to correspond to the nucleotides in an oligonucleotide probe downstream of the discriminating single nucleotide polymorphism.

SEQ ID NO: 2582 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.
atccaaagraatggrggttcyttytgatgyttyt

SEQ ID NO: 2583 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 219 to correspond to the nucleotides in an oligonucleotide probe downstream of the discriminating single nucleotide polymorphism.
hcccatccaaagraatggrggttcyttytgatgytt

SEQ ID NO: 2584 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 219 to correspond to the nucleotides in an oligonucleotide probe downstream of the discriminating single nucleotide polymorphism.
ccatccaaagraatggrggttcyttytgatgytty

SEQ ID NO: 2585 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 219 to correspond to the nucleotides in an oligonucleotide probe downstream of the discriminating single nucleotide polymorphism.
cccatccaaagraatggrggttcyttytgatgyttyt

SEQ ID NO: 2586 - DNA, 39 bp, Artificial Sequence
  Pan degenerate oligonucleotide primer
  primer_bind (1)..(39)
  misc_feature (33)..(39): Adaptor region of the pan degenerate antisense primer that adapts the probe-binding site downstream of codon 219 to correspond to the nucleotides in an oligonucleotide probe downstream of the discriminating single nucleotide polymorphism.
atahcccatccaaagraatggrggttcyttytgatgytt

SEQ ID NO: 2587 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 219 to correspond to the nucleotides in an oligonucleotide probe downstream of the discriminating single nucleotide polymorphism.
ahcccatccaaagraatggrggttcyttytgatgytty

SEQ ID NO: 2588 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.
tahcccatccaaagraatggrggttcyttytgatgyttyt

SEQ ID NO: 2589 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.
catahcccatccaaagraatggrggttcyttytgatgytt

SEQ ID NO: 2590 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.
atahcccatccaaagraatggrggttcyttytgatgytty

SEQ ID NO: 2591 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 219 to correspond to the nucleotides in an oligonucleotide probe downstream of the discriminating single nucleotide polymorphism.
agraatggrggttcyttytgatgyttyt

SEQ ID NO: 2592 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 219 to correspond to the nucleotides in an oligonucleotide probe downstream of the discriminating single nucleotide polymorphism.
ccaaagraatggrggttcyttytgatgytt

SEQ ID NO: 2593 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 219 to correspond to the nucleotides in an oligonucleotide probe downstream of the discriminating single nucleotide polymorphism.
aaagraatggrggttcyttytgatgytty

SEQ ID NO: 2594 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 219 to correspond to the nucleotides in an oligonucleotide probe downstream of the discriminating single nucleotide polymorphism.
caaagraatggrggttcyttytgatgyttyt

SEQ ID NO: 2595 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.
catccaaagraatggrggttcyttytgatgytt

SEQ ID NO: 2596 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.
tccaaagraatggrggttcyttytgatgytty

SEQ ID NO: 2597 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.
ccaaagraatggrggttcyttytgatgyttyt

SEQ ID NO: 2598 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.
ccatccaaagraatggrggttcyttytgatgytt

SEQ ID NO: 2599 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.
atccaaagraatggrggttcyttytgatgytty

SEQ ID NO: 2600 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 219 to correspond to the nucleotides in an oligonucleotide probe downstream of the discriminating single nucleotide polymorphism.
aggatggagytcatahcccatccaragraatggrggttcyttytgatgttt

SEQ ID NO: 2601 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
atccaaagraatggrggttcyttytgatgyttytn

SEQ ID NO: 2602 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
hcccatccaaagraatggrggttcyttytgatgyttn

SEQ ID NO: 2603 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ccatccaaagraatggrggttcyttytgatgyttyn

SEQ ID NO: 2604 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
cccatccaaagraatggrggttcyttytgatgyttytn

SEQ ID NO: 2605 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
atahcccatccaaagraatggrggttcyttytgatgyttn

SEQ ID NO: 2606 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ahcccatccaaagraatggrggttcyttytgatgyttyn

SEQ ID NO: 2607 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tahcccatccaaagraatggrggttcyttytgatgyttytn

SEQ ID NO: 2608 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
catahcccatccaaagraatggrggttcyttytgatgyttn

SEQ ID NO: 2609 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
atahcccatccaaagraatggrggttcyttytgatgyttyn

SEQ ID NO: 2610 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
agraatggrggttcyttytgatgyttytn

SEQ ID NO: 2611 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
ccaaagraatggrggttcyttytgatgyttn

SEQ ID NO: 2612 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
aaagraatggrggttcyttytgatgyttyn

SEQ ID NO: 2613 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
caaagraatggrggttcyttytgatgyttytn

SEQ ID NO: 2614 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
catccaaagraatggrggttcyttytgatgyttn

SEQ ID NO: 2615 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tccaaagraatggrggttcyttytgatgyttyn

SEQ ID NO: 2616 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
ccaaagraatggrggttcyttytgatgyttytn

SEQ ID NO: 2617 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ccatccaaagraatggrggttcyttytgatgyttn

SEQ ID NO: 2618 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
atccaaagraatggrggttcyttytgatgyttyn

SEQ ID NO: 2619 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 219 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
aggatggagytcatahcccatccaragraatggrggttcyttytgatgtttn

SEQ ID NO: 2620 - DNA, 34 bp, Artificial Sequence; identical to SEQ ID NO: 2582
  Pan degenerate oligonucleotide primer
  primer_bind (1)..(34)
  modified_base (1)..(1): base is a locked nucleic acid
  modified_base (3)..(3): base is a locked nucleic acid
  modified_base (7)..(7): base is a locked nucleic acid
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2621 - DNA, 36 bp, Artificial Sequence; identical to SEQ ID NO: 2583
  Pan degenerate oligonucleotide primer
  primer_bind (1)..(36)
  modified_base (1)..(1): base is a locked nucleic acid
  modified_base (3)..(3): base is a locked nucleic acid
  modified_base (7)..(7): base is a locked nucleic acid
  misc_feature (30)..(36): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2622 - DNA, 35 bp, Artificial Sequence; identical to SEQ ID NO: 2584
  Pan degenerate oligonucleotide primer
  primer_bind (1)..(35)
  modified_base (1)..(1): base is a locked nucleic acid
  modified_base (3)..(3): base is a locked nucleic acid
  modified_base (7)..(7): base is a locked nucleic acid
  misc_feature (29)..(35): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2623 - DNA, 34 bp, Artificial Sequence; identical to SEQ ID NO: 2582
  Pan degenerate oligonucleotide primer
  primer_bind (1)..(34)
  modified_base (1)..(1): base is a locked nucleic acid
  modified_base (4)..(4): base is a locked nucleic acid
  modified_base (7)..(7): base is a locked nucleic acid
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2624 - DNA, 36 bp, Artificial Sequence; identical to SEQ ID NO: 2583
  Pan degenerate oligonucleotide primer
  primer_bind (1)..(36)
  modified_base (1)..(1): base is a locked nucleic acid
  modified_base (4)..(4): base is a locked nucleic acid
  modified_base (7)..(7): base is a locked nucleic acid
  misc_feature (30)..(36): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2625 - DNA, 35 bp, Artificial Sequence; identical to SEQ ID NO: 2584
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2626 - DNA, 34 bp, Artificial Sequence; identical to SEQ ID NO: 2582
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2627 - DNA, 36 bp, Artificial Sequence; identical to SEQ ID NO: 2583
  Pan degenerate oligonucleotide primer
  primer_bind (1)..(36)
  modified_base (1)..(1): base is a locked nucleic acid
  modified_base (3)..(3): base is a locked nucleic acid
  modified_base (4)..(4): base is a locked nucleic acid
  misc_feature (30)..(36): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2628 - DNA, 35 bp, Artificial Sequence; identical to SEQ ID NO: 2584
  Pan degenerate oligonucleotide primer
  primer_bind (1)..(35)
  modified_base (1)..(1): base is a locked nucleic acid
  modified_base (3)..(3): base is a locked nucleic acid
  modified_base (4)..(4): base is a locked nucleic acid
  misc_feature (29)..(35): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2629 - DNA, 37 bp, Artificial Sequence; identical to SEQ ID NO: 2585
  Pan degenerate oligonucleotide primer
  primer_bind (1)..(37)
  modified_base (1)..(1): base is a locked nucleic acid
  modified_base (4)..(4): base is a locked nucleic acid
  modified_base (7)..(7): base is a locked nucleic acid
  misc_feature (31)..(37): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2630 - DNA, 39 bp, Artificial Sequence; identical to SEQ ID NO: 2586
  Pan degenerate oligonucleotide primer
  primer_bind (1)..(39)
  modified_base (1)..(1): base is a locked nucleic acid
  modified_base (4)..(4): base is a locked nucleic acid
  modified_base (7)..(7): base is a locked nucleic acid
  misc_feature (33)..(39): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2631 - DNA, 38 bp, Artificial Sequence; identical to SEQ ID NO: 2587
  Pan degenerate oligonucleotide primer
  primer_bind (1)..(38)
  modified_base (1)..(1): base is a locked nucleic acid
  modified_base (4)..(4): base is a locked nucleic acid
  modified_base (7)..(7): base is a locked nucleic acid
  misc_feature (32)..(38): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2632 - DNA, 37 bp, Artificial Sequence; identical to SEQ ID NO: 2585
  Pan degenerate oligonucleotide primer
  primer_bind (1)..(37)
  modified_base (1)..(1): base is a locked nucleic acid
  modified_base (6)..(6): base is a locked nucleic acid
  modified_base (7)..(7): base is a locked nucleic acid
  misc_feature (31)..(37): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2633 - DNA, 39 bp, Artificial Sequence; identical to SEQ ID NO: 2586
  Pan degenerate oligonucleotide primer
  primer_bind (1)..(39)
  modified_base (1)..(1): base is a locked nucleic acid
  modified_base (6)..(6): base is a locked nucleic acid
  modified_base (7)..(7): base is a locked nucleic acid
  misc_feature (33)..(39): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2634 - DNA, 38 bp, Artificial Sequence; identical to SEQ ID NO: 2587
  Pan degenerate oligonucleotide primer
  primer_bind (1)..(38)
  modified_base (1)..(1): base is a locked nucleic acid
  modified_base (6)..(6): base is a locked nucleic acid
  modified_base (7)..(7): base is a locked nucleic acid
  misc_feature (32)..(38): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2635 - DNA, 37 bp, Artificial Sequence; identical to SEQ ID NO: 2585
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2636 - DNA, 39 bp, Artificial Sequence; identical to SEQ ID NO: 2586
  Pan degenerate oligonucleotide primer
  primer_bind (1)..(39)
  modified_base (1)..(1): base is a locked nucleic acid
  modified_base (4)..(4): base is a locked nucleic acid
  modified_base (6)..(6): base is a locked nucleic acid
  misc_feature (33)..(39): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2637 - DNA, 38 bp, Artificial Sequence; identical to SEQ ID NO: 2587
  Pan degenerate oligonucleotide primer
  primer_bind (1)..(38)
  modified_base (1)..(1): base is a locked nucleic acid
  modified_base (4)..(4): base is a locked nucleic acid
  modified_base (6)..(6): base is a locked nucleic acid
  misc_feature (32)..(38): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2638 - DNA, 40 bp, Artificial Sequence; identical to SEQ ID NO: 2588
  Pan degenerate oligonucleotide primer
  primer_bind (1)..(40)
  modified_base (1)..(1): base is a locked nucleic acid
  modified_base (3)..(3): base is a locked nucleic acid
  modified_base (7)..(7): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2639 - DNA, 40 bp, Artificial Sequence; identical to SEQ ID NO: 2589
  Pan degenerate oligonucleotide primer
  primer_bind (1)..(40)
  modified_base (1)..(1): base is a locked nucleic acid
  modified_base (2)..(2): base is a locked nucleic acid
  modified_base (7)..(7): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2640 - DNA, 40 bp, Artificial Sequence; identical to SEQ ID NO: 2590
  Pan degenerate oligonucleotide primer
  primer_bind (1)..(40)
  modified_base (2)..(2): base is a locked nucleic acid
  modified_base (3)..(3): base is a locked nucleic acid
  modified_base (8)..(8): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2641 - DNA, 40 bp, Artificial Sequence; identical to SEQ ID NO: 2589
  Pan degenerate oligonucleotide primer
  primer_bind (1)..(40)
  modified_base (1)..(1): base is a locked nucleic acid
  modified_base (5)..(5): base is a locked nucleic acid
  modified_base (7)..(7): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2642 - DNA, 40 bp, Artificial Sequence; identical to SEQ ID NO: 2590
  Pan degenerate oligonucleotide primer
  primer_bind (1)..(40)
  modified_base (2)..(2): base is a locked nucleic acid
  modified_base (6)..(6): base is a locked nucleic acid
  modified_base (8)..(8): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2643 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (6)..(6): base is a locked nucleic acid
  misc_feature (22)..(28): Adaptor region of the pan degenerate antisense primer that adapts the probe-binding site downstream of codon 219 to correspond to the nucleotides in an oligonucleotide probe downstream of the discriminating single nucleotide polymorphism.
agraatggrggttcyttytgatgyttyt

SEQ ID NO: 2644 - DNA, 30 bp, Artificial Sequence; identical to SEQ ID NO: 2592
  Pan degenerate oligonucleotide primer
  primer_bind (1)..(30)
  modified_base (1)..(1): base is a locked nucleic acid
  modified_base (3)..(3): base is a locked nucleic acid
  modified_base (6)..(6): base is a locked nucleic acid
  misc_feature (24)..(30): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2645 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (6)..(6): base is a locked nucleic acid
  misc_feature (23)..(29): Adaptor region of the pan degenerate antisense primer that adapts the probe-binding site downstream of codon 219 to correspond to the nucleotides in an oligonucleotide probe downstream of the discriminating single nucleotide polymorphism.
aaagraatggrggttcyttytgatgytty

SEQ ID NO: 2646 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (6)..(6): base is a locked nucleic acid
  misc_feature (22)..(28): Adaptor region of the pan degenerate antisense primer that adapts the probe-binding site downstream of codon 219 to correspond to the nucleotides in an oligonucleotide probe downstream of the discriminating single nucleotide polymorphism.
agraatggrggttcyttytgatgyttyt

SEQ ID NO: 2647 - DNA, 30 bp, Artificial Sequence; identical to SEQ ID NO: 2592
  Pan degenerate oligonucleotide primer
  primer_bind (1)..(30)
  modified_base (1)..(1): base is a locked nucleic acid
  modified_base (4)..(4): base is a locked nucleic acid
  modified_base (6)..(6): base is a locked nucleic acid
  misc_feature (24)..(30): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2648 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (6)..(6): base is a locked nucleic acid
  misc_feature (23)..(29): Adaptor region of the pan degenerate antisense primer that adapts the probe-binding site downstream of codon 219 to correspond to the nucleotides in an oligonucleotide probe downstream of the discriminating single nucleotide polymorphism.
aaagraatggrggttcyttytgatgytty

SEQ ID NO: 2649 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 219 to correspond to the nucleotides in an oligonucleotide probe downstream of the discriminating single nucleotide polymorphism.
agraatggrggttcyttytgatgyttyt

SEQ ID NO: 2650 - DNA, 30 bp, Artificial Sequence; identical to SEQ ID NO: 2592
  Pan degenerate oligonucleotide primer
  primer_bind (1)..(30)
  modified_base (1)..(1): base is a locked nucleic acid
  modified_base (3)..(3): base is a locked nucleic acid
  modified_base (4)..(4): base is a locked nucleic acid
  misc_feature (24)..(30): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2651 - DNA, 29 bp, Artificial Sequence
  Pan degenerate oligonucleotide primer
  primer_bind (1)..(29)
  modified_base (1)..(1): base is a locked nucleic acid
  modified_base (3)..(3): base is a locked nucleic acid
  modified_base (4)..(4): base is a locked nucleic acid
  misc_feature (23)..(29): Adaptor region of the pan degenerate antisense primer that adapts the probe-binding site downstream of codon 219 to correspond to the nucleotides in an oligonucleotide probe downstream of the discriminating single nucleotide polymorphism.
aaagraatggrggttcyttytgatgytty

SEQ ID NO: 2652 - DNA, 31 bp, Artificial Sequence; identical to SEQ ID NO: 2594
  Pan degenerate oligonucleotide primer
  primer_bind (1)..(31)
  modified_base (1)..(1): base is a locked nucleic acid
  modified_base (4)..(4): base is a locked nucleic acid
  modified_base (7)..(7): base is a locked nucleic acid
  misc_feature (25)..(31): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2653 - DNA, 33 bp, Artificial Sequence; identical to SEQ ID NO: 2595
  Pan degenerate oligonucleotide primer
  primer_bind (1)..(33)
  modified_base (1)..(1): base is a locked nucleic acid
  modified_base (4)..(4): base is a locked nucleic acid
  modified_base (7)..(7): base is a locked nucleic acid
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2654 - DNA, 32 bp, Artificial Sequence; identical to SEQ ID NO: 2596
  Pan degenerate oligonucleotide primer
  primer_bind (1)..(32)
  modified_base (1)..(1): base is a locked nucleic acid
  modified_base (4)..(4): base is a locked nucleic acid
  modified_base (7)..(7): base is a locked nucleic acid
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2655 - DNA, 31 bp, Artificial Sequence; identical to SEQ ID NO: 2594
  Pan degenerate oligonucleotide primer
  primer_bind (1)..(31)
  modified_base (1)..(1): base is a locked nucleic acid
  modified_base (6)..(6): base is a locked nucleic acid
  modified_base (7)..(7): base is a locked nucleic acid
  misc_feature (25)..(31): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2656 - DNA, 33 bp, Artificial Sequence; identical to SEQ ID NO: 2595
  Pan degenerate oligonucleotide primer
  primer_bind (1)..(33)
  modified_base (1)..(1): base is a locked nucleic acid
  modified_base (6)..(6): base is a locked nucleic acid
  modified_base (7)..(7): base is a locked nucleic acid
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2657 - DNA, 32 bp, Artificial Sequence; identical to SEQ ID NO: 2596
  Pan degenerate oligonucleotide primer
  primer_bind (1)..(32)
  modified_base (1)..(1): base is a locked nucleic acid
  modified_base (6)..(6): base is a locked nucleic acid
  modified_base (7)..(7): base is a locked nucleic acid
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2658 - DNA, 31 bp, Artificial Sequence; identical to SEQ ID NO: 2594
  Pan degenerate oligonucleotide primer
  primer_bind (1)..(31)
  modified_base (1)..(1): base is a locked nucleic acid
  modified_base (4)..(4): base is a locked nucleic acid
  modified_base (6)..(6): base is a locked nucleic acid
  misc_feature (25)..(31): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2659 - DNA, 33 bp, Artificial Sequence; identical to SEQ ID NO: 2595
  Pan degenerate oligonucleotide primer
  primer_bind (1)..(33)
  modified_base (1)..(1): base is a locked nucleic acid
  modified_base (4)..(4): base is a locked nucleic acid
  modified_base (6)..(6): base is a locked nucleic acid
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2660 - DNA, 32 bp, Artificial Sequence; identical to SEQ ID NO: 2596
  Pan degenerate oligonucleotide primer
  primer_bind (1)..(32)
  modified_base (1)..(1): base is a locked nucleic acid
  modified_base (4)..(4): base is a locked nucleic acid
  modified_base (6)..(6): base is a locked nucleic acid
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2661 - DNA, 32 bp, Artificial Sequence; identical to SEQ ID NO: 2597
  Pan degenerate oligonucleotide primer
  primer_bind (1)..(32)
  modified_base (1)..(1): base is a locked nucleic acid
  modified_base (2)..(2): base is a locked nucleic acid
  modified_base (7)..(7): base is a locked nucleic acid
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2662 - DNA, 34 bp, Artificial Sequence; identical to SEQ ID NO: 2598
  Pan degenerate oligonucleotide primer
  primer_bind (1)..(34)
  modified_base (1)..(1): base is a locked nucleic acid
  modified_base (2)..(2): base is a locked nucleic acid
  modified_base (7)..(7): base is a locked nucleic acid
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2663 - DNA, 33 bp, Artificial Sequence; identical to SEQ ID NO: 2599
  Pan degenerate oligonucleotide primer
  primer_bind (1)..(33)
  modified_base (1)..(1): base is a locked nucleic acid
  modified_base (2)..(2): base is a locked nucleic acid
  modified_base (7)..(7): base is a locked nucleic acid
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2664 - DNA, 32 bp, Artificial Sequence; identical to SEQ ID NO: 2597
  Pan degenerate oligonucleotide primer
  primer_bind (1)..(32)
  modified_base (1)..(1): base is a locked nucleic acid
  modified_base (5)..(5): base is a locked nucleic acid
  modified_base (7)..(7): base is a locked nucleic acid
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2665 - DNA, 34 bp, Artificial Sequence; identical to SEQ ID NO: 2598
  Pan degenerate oligonucleotide primer
  primer_bind (1)..(34)
  modified_base (1)..(1): base is a locked nucleic acid
  modified_base (5)..(5): base is a locked nucleic acid
  modified_base (7)..(7): base is a locked nucleic acid
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2666 - DNA, 33 bp, Artificial Sequence; identical to SEQ ID NO: 2599
  Pan degenerate oligonucleotide primer
  primer_bind (1)..(33)
  modified_base (1)..(1): base is a locked nucleic acid
  modified_base (5)..(5): base is a locked nucleic acid
  modified_base (7)..(7): base is a locked nucleic acid
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2667 - DNA, 32 bp, Artificial Sequence; identical to SEQ ID NO: 2597
  Pan degenerate oligonucleotide primer
  primer_bind (1)..(32)
  modified_base (1)..(1): base is a locked nucleic acid
  modified_base (2)..(2): base is a locked nucleic acid
  modified_base (5)..(5): base is a locked nucleic acid
  misc_feature (26)..(32): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2668 - DNA, 34 bp, Artificial Sequence; identical to SEQ ID NO: 2598
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2669 - DNA, 33 bp, Artificial Sequence; identical to SEQ ID NO: 2599
  Pan degenerate oligonucleotide primer
  primer_bind (1)..(33)
  modified_base (1)..(1): base is a locked nucleic acid
  modified_base (2)..(2): base is a locked nucleic acid
  modified_base (5)..(5): base is a locked nucleic acid
  misc_feature (27)..(33): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2670 - DNA, 40 bp, Artificial Sequence; identical to SEQ ID NO: 2588
  Pan degenerate oligonucleotide primer
  primer_bind (1)..(40)
  modified_base (3)..(3): base is a locked nucleic acid
  modified_base (4)..(4): base is a locked nucleic acid
  modified_base (7)..(7): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2671 - DNA, 40 bp, Artificial Sequence; identical to SEQ ID NO: 2589
  Pan degenerate oligonucleotide primer
  primer_bind (1)..(40)
  modified_base (1)..(1): base is a locked nucleic acid
  modified_base (2)..(2): base is a locked nucleic acid
  modified_base (5)..(5): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2672 - DNA, 40 bp, Artificial Sequence; identical to SEQ ID NO: 2590
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 219 to correspond to the nucleotides in an oligonucleotide probe downstream of the discriminating single nucleotide polymorphism.

SEQ ID NO: 2673 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 225 to correspond to the nucleotides in an oligonucleotide probe downstream of the discriminating single nucleotide polymorphism.
caggatggagytcatahcccatccaaagraatggr

SEQ ID NO: 2674 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 225 to correspond to the nucleotides in an oligonucleotide probe downstream of the discriminating single nucleotide polymorphism.
trtcaggatggagytcatahcccatccaaagraatggr

SEQ ID NO: 2675 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 225 to correspond to the nucleotides in an oligonucleotide probe downstream of the discriminating single nucleotide polymorphism.
yttrtcaggatggagytcatahcccatccaaagraatggr

SEQ ID NO: 2676 - DNA, 28 bp, Artificial Sequence
  Pan degenerate oligonucleotide primer
  primer_bind (1)..(28)
  misc_feature (22)..(28): Adaptor region of the pan degenerate antisense primer that adapts the probe-binding site downstream of codon 225 to correspond to the nucleotides in an oligonucleotide probe downstream of the discriminating single nucleotide polymorphism.
gagytcatahcccatccaaagraatggr

SEQ ID NO: 2677 - DNA, 29 bp, Artificial Sequence
  Pan degenerate oligonucleotide primer
  primer_bind (1)..(29)
  misc_feature (23)..(29): Adaptor region of the pan degenerate antisense primer that adapts the probe-binding site downstream of codon 225 to correspond to the nucleotides in an oligonucleotide probe downstream of the discriminating single nucleotide polymorphism.
ggagytcatahcccatccaaagraatggr

SEQ ID NO: 2678 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 225 to correspond to the nucleotides in an oligonucleotide probe downstream of the discriminating single nucleotide polymorphism.
tggagytcatahcccatccaaagraatggr

SEQ ID NO: 2679 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 225 to correspond to the nucleotides in an oligonucleotide probe downstream of the discriminating single nucleotide polymorphism.
ytgbactgtccayytrtcaggatggagytcatahcccatccaraggaatgg

SEQ ID NO: 2680 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 225 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
caggatggagytcatahcccatccaaagraatggrn

SEQ ID NO: 2681 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 225 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
trtcaggatggagytcatahcccatccaaagraatggrn

SEQ ID NO: 2682 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 225 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
yttrtcaggatggagytcatahcccatccaaagraatggrn

SEQ ID NO: 2683 - DNA, 29 bp, Artificial Sequence
  Pan degenerate oligonucleotide primer
  primer_bind (1)..(29)
  misc_feature (22)..(28): Adaptor region of the pan degenerate antisense primer that adapts the probe-binding site downstream of codon 225 to correspond to the nucleotides in an oligonucleotide probe downstream of the discriminating single nucleotide polymorphism.
  modified_base (29)..(29): base is a locked nucleic acid
  misc_feature (29)..(29): n is a, c, g, or t
gagytcatahcccatccaaagraatggrn

SEQ ID NO: 2684 - DNA, 30 bp, Artificial Sequence
  Pan degenerate oligonucleotide primer
  primer_bind (1)..(30)
  misc_feature (23)..(29): Adaptor region of the pan degenerate antisense primer that adapts the probe-binding site downstream of codon 225 to correspond to the nucleotides in an oligonucleotide probe downstream of the discriminating single nucleotide polymorphism.
  modified_base (30)..(30): base is a locked nucleic acid
  misc_feature (30)..(30): n is a, c, g, or t
ggagytcatahcccatccaaagraatggrn

SEQ ID NO: 2685 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 225 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tggagytcatahcccatccaaagraatggrn

SEQ ID NO: 2686 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 225 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
ytgbactgtccayytrtcaggatggagytcatahcccatccaraggaatggn

SEQ ID NO: 2687 - DNA, 35 bp, Artificial Sequence; identical to SEQ ID NO: 2673
  Pan degenerate oligonucleotide primer
  primer_bind (1)..(35)
  modified_base (1)..(1): base is a locked nucleic acid
  modified_base (6)..(6): base is a locked nucleic acid
  modified_base (8)..(8): base is a locked nucleic acid
  misc_feature (29)..(35): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2688 - DNA, 35 bp, Artificial Sequence; identical to SEQ ID NO: 2673
  Pan degenerate oligonucleotide primer
  primer_bind (1)..(35)
  modified_base (1)..(1): base is a locked nucleic acid
  modified_base (7)..(7): base is a locked nucleic acid
  modified_base (8)..(8): base is a locked nucleic acid
  misc_feature (29)..(35): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2689 - DNA, 35 bp, Artificial Sequence; identical to SEQ ID NO: 2673
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2690 - DNA, 38 bp, Artificial Sequence; identical to SEQ ID NO: 2674
  Pan degenerate oligonucleotide primer
  primer_bind (1)..(38)
  modified_base (1)..(1): base is a locked nucleic acid
  modified_base (4)..(4): base is a locked nucleic acid
  modified_base (10)..(10): base is a locked nucleic acid
  misc_feature (32)..(38): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2691 - DNA, 38 bp, Artificial Sequence; identical to SEQ ID NO: 2674
  Pan degenerate oligonucleotide primer
  primer_bind (1)..(38)
  modified_base (1)..(1): base is a locked nucleic acid
  modified_base (9)..(9): base is a locked nucleic acid
  modified_base (10)..(10): base is a locked nucleic acid
  misc_feature (32)..(38): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2692 - DNA, 38 bp, Artificial Sequence; identical to SEQ ID NO: 2674
  Pan degenerate oligonucleotide primer
  primer_bind (1)..(38)
  modified_base (1)..(1): base is a locked nucleic acid
  modified_base (4)..(4): base is a locked nucleic acid
  modified_base (9)..(9): base is a locked nucleic acid
  misc_feature (32)..(38): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2693 - DNA, 40 bp, Artificial Sequence; identical to SEQ ID NO: 2675
  Pan degenerate oligonucleotide primer
  primer_bind (1)..(40)
  modified_base (2)..(2): base is a locked nucleic acid
  modified_base (3)..(3): base is a locked nucleic acid
  modified_base (11)..(11): base is a locked nucleic acid
  misc_feature (34)..(40): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2694 - DNA, 40 bp, Artificial Sequence; identical to SEQ ID NO: 2675
  Pan degenerate oligonucleotide primer
  primer_bind (1)..(40)
  modified_base (2)..(2): base is a locked nucleic acid
  modified_base (6)..(6): base is a locked nucleic acid
  modified_base (11)..(11): base is a locked nucleic acid
  misc_feature (34)..(40): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2695 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (5)..(5): base is a locked nucleic acid
  misc_feature (22)..(28): Adaptor region of the pan degenerate antisense primer that adapts the probe-binding site downstream of codon 225 to correspond to the nucleotides in an oligonucleotide probe downstream of the discriminating single nucleotide polymorphism.
gagytcatahcccatccaaagraatggr

SEQ ID NO: 2696 - DNA, 28 bp, Artificial Sequence
  Pan degenerate oligonucleotide primer
  primer_bind (1)..(28)
  modified_base (1)..(1): base is a locked nucleic acid
  modified_base (4)..(4): base is a locked nucleic acid
  modified_base (5)..(5): base is a locked nucleic acid
  misc_feature (22)..(28): Adaptor region of the pan degenerate antisense primer that adapts the probe-binding site downstream of codon 225 to correspond to the nucleotides in an oligonucleotide probe downstream of the discriminating single nucleotide polymorphism.
gagytcatahcccatccaaagraatggr

SEQ ID NO: 2697 - DNA, 28 bp, Artificial Sequence
  Pan degenerate oligonucleotide primer
  primer_bind (1)..(28)
  modified_base (1)..(1): base is a locked nucleic acid
  modified_base (3)..(3): base is a locked nucleic acid
  modified_base (4)..(4): base is a locked nucleic acid
  misc_feature (22)..(28): Adaptor region of the pan degenerate antisense primer that adapts the probe-binding site downstream of codon 225 to correspond to the nucleotides in an oligonucleotide probe downstream of the discriminating single nucleotide polymorphism.
gagytcatahcccatccaaagraatggr

SEQ ID NO: 2698 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (5)..(5): base is a locked nucleic acid
  misc_feature (23)..(29): Adaptor region of the pan degenerate antisense primer that adapts the probe-binding site downstream of codon 225 to correspond to the nucleotides in an oligonucleotide probe downstream of the discriminating single nucleotide polymorphism.
ggagytcatahcccatccaaagraatggr

SEQ ID NO: 2699 - DNA, 29 bp, Artificial Sequence
  Pan degenerate oligonucleotide primer
  primer_bind (1)..(29)
  modified_base (1)..(1): base is a locked nucleic acid
  modified_base (4)..(4): base is a locked nucleic acid
  modified_base (5)..(5): base is a locked nucleic acid
  misc_feature (23)..(29): Adaptor region of the pan degenerate antisense primer that adapts the probe-binding site downstream of codon 225 to correspond to the nucleotides in an oligonucleotide probe downstream of the discriminating single nucleotide polymorphism.
ggagytcatahcccatccaaagraatggr

SEQ ID NO: 2700 - DNA, 29 bp, Artificial Sequence
  Pan degenerate oligonucleotide primer
  primer_bind (1)..(29)
  modified_base (1)..(1): base is a locked nucleic acid
  modified_base (2)..(2): base is a locked nucleic acid
  modified_base (4)..(4): base is a locked nucleic acid
  misc_feature (23)..(29): Adaptor region of the pan degenerate antisense primer that adapts the probe-binding site downstream of codon 225 to correspond to the nucleotides in an oligonucleotide probe downstream of the discriminating single nucleotide polymorphism.
ggagytcatahcccatccaaagraatggr

SEQ ID NO: 2701 - DNA, 30 bp, Artificial Sequence; identical to SEQ ID NO: 2678
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2702 - DNA, 30 bp, Artificial Sequence; identical to SEQ ID NO: 2678
  Pan degenerate oligonucleotide primer
  primer_bind (1)..(30)
  modified_base (1)..(1): base is a locked nucleic acid
  modified_base (3)..(3): base is a locked nucleic acid
  modified_base (5)..(5): base is a locked nucleic acid
  misc_feature (24)..(30): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2703 - DNA, 30 bp, Artificial Sequence; identical to SEQ ID NO: 2678
  Pan degenerate oligonucleotide primer
  primer_bind (1)..(30)
  modified_base (1)..(1): base is a locked nucleic acid
  modified_base (2)..(2): base is a locked nucleic acid
  modified_base (3)..(3): base is a locked nucleic acid
  misc_feature (24)..(30): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2704 - DNA, 40 bp, Artificial Sequence; identical to SEQ ID NO: 2675
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 225 to correspond to the nucleotides in an oligonucleotide probe downstream of the discriminating single nucleotide polymorphism.

SEQ ID NO: 2705 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.
ttrtcaggatggagytcatahcccatccaaagra

SEQ ID NO: 2706 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.
yttrtcaggatggagytcatahcccatccaaagr

SEQ ID NO: 2707 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.
yttrtcaggatggagytcatahcccatccaaagra

SEQ ID NO: 2708 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.
ayttrtcaggatggagytcatahcccatccaaagr

SEQ ID NO: 2709 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.
gtccayttrtcaggatggagytcatahcccatccaaagra

SEQ ID NO: 2710 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.
tgtccayttrtcaggatggagytcatahcccatccaaagr

SEQ ID NO: 2711 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.
caggatggagytcatahcccatccaaagra

SEQ ID NO: 2712 - DNA, 30 bp, Artificial Sequence
  Pan degenerate oligonucleotide primer
  primer_bind (1)..(30)
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.
tcaggatggagytcatahcccatccaaagr

SEQ ID NO: 2713 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.
tcaggatggagytcatahcccatccaaagra

SEQ ID NO: 2714 - DNA, 31 bp, Artificial Sequence
  Pan degenerate oligonucleotide primer
  primer_bind (1)..(31)
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.
rtcaggatggagytcatahcccatccaaagr

SEQ ID NO: 2715 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 227 to correspond to the nucleotides in an oligonucleotide probe downstream of the discriminating single nucleotide polymorphism.
trtcaggatggagytcatahcccatccaaagra

SEQ ID NO: 2716 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 227 to correspond to the nucleotides in an oligonucleotide probe downstream of the discriminating single nucleotide polymorphism.
trtcaggatggagytcatahcccatccaaagr

SEQ ID NO: 2717 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 227 to correspond to the nucleotides in an oligonucleotide probe downstream of the discriminating single nucleotide polymorphism.
tataggytgbactgtccayytrtcaggatggagytcatahcccatccaaag

SEQ ID NO: 2718 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
ttrtcaggatggagytcatahcccatccaaagran

SEQ ID NO: 2719 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
yttrtcaggatggagytcatahcccatccaaagrn

SEQ ID NO: 2720 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
yttrtcaggatggagytcatahcccatccaaagran

SEQ ID NO: 2721 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
ayttrtcaggatggagytcatahcccatccaaagrn

SEQ ID NO: 2722 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gtccayttrtcaggatggagytcatahcccatccaaagran

SEQ ID NO: 2723 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
tgtccayttrtcaggatggagytcatahcccatccaaagrn

SEQ ID NO: 2724 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
caggatggagytcatahcccatccaaagran

SEQ ID NO: 2725 - DNA, 31 bp, Artificial Sequence
  Pan degenerate oligonucleotide primer
  primer_bind (1)..(31)
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (31)..(31): base is a locked nucleic acid
  misc_feature (31)..(31): n is a, c, g, or t
tcaggatggagytcatahcccatccaaagrn

SEQ ID NO: 2726 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
tcaggatggagytcatahcccatccaaagran

SEQ ID NO: 2727 - DNA, 32 bp, Artificial Sequence
  Pan degenerate oligonucleotide primer
  primer_bind (1)..(32)
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (32)..(32): base is a locked nucleic acid
  misc_feature (32)..(32): n is a, c, g, or t
rtcaggatggagytcatahcccatccaaagrn

SEQ ID NO: 2728 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
trtcaggatggagytcatahcccatccaaagran

SEQ ID NO: 2729 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
trtcaggatggagytcatahcccatccaaagrn

SEQ ID NO: 2730 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 227 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
tataggytgbactgtccayytrtcaggatggagytcatahcccatccaaagn

SEQ ID NO: 2731 - DNA, 34 bp, Artificial Sequence; identical to SEQ ID NO: 2705
  Pan degenerate oligonucleotide primer
  primer_bind (1)..(34)
  modified_base (1)..(1): base is a locked nucleic acid
  modified_base (2)..(2): base is a locked nucleic acid
  modified_base (5)..(5): base is a locked nucleic acid
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2732 - DNA, 34 bp, Artificial Sequence; identical to SEQ ID NO: 2706
  Pan degenerate oligonucleotide primer
  primer_bind (1)..(34)
  modified_base (1)..(1): base is a locked nucleic acid
  modified_base (3)..(3): base is a locked nucleic acid
  modified_base (5)..(5): base is a locked nucleic acid
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2733 - DNA, 34 bp, Artificial Sequence; identical to SEQ ID NO: 2705
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2734 - DNA, 34 bp, Artificial Sequence; identical to SEQ ID NO: 2706
  Pan degenerate oligonucleotide primer
  primer_bind (1)..(34)
  modified_base (1)..(1): base is a locked nucleic acid
  modified_base (4)..(4): base is a locked nucleic acid
  modified_base (5)..(5): base is a locked nucleic acid
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2735 - DNA, 34 bp, Artificial Sequence; identical to SEQ ID NO: 2705
  Pan degenerate oligonucleotide primer
  primer_bind (1)..(34)
  modified_base (1)..(1): base is a locked nucleic acid
  modified_base (2)..(2): base is a locked nucleic acid
  modified_base (4)..(4): base is a locked nucleic acid
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2736 - DNA, 34 bp, Artificial Sequence; identical to SEQ ID NO: 2706
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2737 - DNA, 35 bp, Artificial Sequence; identical to SEQ ID NO: 2707
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2738 - DNA, 35 bp, Artificial Sequence; identical to SEQ ID NO: 2708
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2739 - DNA, 35 bp, Artificial Sequence; identical to SEQ ID NO: 2707
  Pan degenerate oligonucleotide primer
  primer_bind (1)..(35)
  modified_base (1)..(1): base is a locked nucleic acid
  modified_base (3)..(3): base is a locked nucleic acid
  modified_base (5)..(5): base is a locked nucleic acid
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2740 - DNA, 35 bp, Artificial Sequence; identical to SEQ ID NO: 2708
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2741 - DNA, 35 bp, Artificial Sequence; identical to SEQ ID NO: 2707
  Pan degenerate oligonucleotide primer
  primer_bind (1)..(35)
  modified_base (1)..(1): base is a locked nucleic acid
  modified_base (2)..(2): base is a locked nucleic acid
  modified_base (3)..(3): base is a locked nucleic acid
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2742 - DNA, 35 bp, Artificial Sequence; identical to SEQ ID NO: 2708
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2743 - DNA, 40 bp, Artificial Sequence; identical to SEQ ID NO: 2709
  Pan degenerate oligonucleotide primer
  primer_bind (1)..(40)
  modified_base (1)..(1): base is a locked nucleic acid
  modified_base (6)..(6): base is a locked nucleic acid
  modified_base (8)..(8): base is a locked nucleic acid
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2744 - DNA, 40 bp, Artificial Sequence; identical to SEQ ID NO: 2710
  Pan degenerate oligonucleotide primer
  primer_bind (1)..(40)
  modified_base (5)..(5): base is a locked nucleic acid
  modified_base (6)..(6): base is a locked nucleic acid
  modified_base (9)..(9): base is a locked nucleic acid
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2745 - DNA, 40 bp, Artificial Sequence; identical to SEQ ID NO: 2709
  Pan degenerate oligonucleotide primer
  primer_bind (1)..(40)
  modified_base (1)..(1): base is a locked nucleic acid
  modified_base (7)..(7): base is a locked nucleic acid
  modified_base (8)..(8): base is a locked nucleic acid
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2746 - DNA, 40 bp, Artificial Sequence; identical to SEQ ID NO: 2710
  Pan degenerate oligonucleotide primer
  primer_bind (1)..(40)
  modified_base (5)..(5): base is a locked nucleic acid
  modified_base (7)..(7): base is a locked nucleic acid
  modified_base (9)..(9): base is a locked nucleic acid
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2747 - DNA, 30 bp, Artificial Sequence; identical to SEQ ID NO: 2711
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2748 - DNA, 30 bp, Artificial Sequence; identical to SEQ ID NO: 2712
  Pan degenerate oligonucleotide primer
  primer_bind (1)..(30)
  modified_base (1)..(1): base is a locked nucleic acid
  modified_base (2)..(2): base is a locked nucleic acid
  modified_base (5)..(5): base is a locked nucleic acid
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2749 - DNA, 30 bp, Artificial Sequence; identical to SEQ ID NO: 2711
  Pan degenerate oligonucleotide primer
  primer_bind (1)..(30)
  modified_base (1)..(1): base is a locked nucleic acid
  modified_base (3)..(3): base is a locked nucleic acid
  modified_base (5)..(5): base is a locked nucleic acid
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2750 - DNA, 30 bp, Artificial Sequence; identical to SEQ ID NO: 2712
  Pan degenerate oligonucleotide primer
  primer_bind (1)..(30)
  modified_base (1)..(1): base is a locked nucleic acid
  modified_base (4)..(4): base is a locked nucleic acid
  modified_base (5)..(5): base is a locked nucleic acid
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2751 - DNA, 30 bp, Artificial Sequence; identical to SEQ ID NO: 2711
  Pan degenerate oligonucleotide primer
  primer_bind (1)..(30)
  modified_base (1)..(1): base is a locked nucleic acid
  modified_base (2)..(2): base is a locked nucleic acid
  modified_base (3)..(3): base is a locked nucleic acid
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2752 - DNA, 30 bp, Artificial Sequence; identical to SEQ ID NO: 2712
  Pan degenerate oligonucleotide primer
  primer_bind (1)..(30)
  modified_base (1)..(1): base is a locked nucleic acid
  modified_base (2)..(2): base is a locked nucleic acid
  modified_base (4)..(4): base is a locked nucleic acid
  misc_feature (24)..(30): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2753 - DNA, 31 bp, Artificial Sequence; identical to SEQ ID NO: 2713
  Pan degenerate oligonucleotide primer
  primer_bind (1)..(31)
  modified_base (1)..(1): base is a locked nucleic acid
  modified_base (2)..(2): base is a locked nucleic acid
  modified_base (4)..(4): base is a locked nucleic acid
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2754 - DNA, 31 bp, Artificial Sequence; identical to SEQ ID NO: 2714
  Pan degenerate oligonucleotide primer
  primer_bind (1)..(31)
  modified_base (1)..(1): base is a locked nucleic acid
  modified_base (2)..(2): base is a locked nucleic acid
  modified_base (5)..(5): base is a locked nucleic acid
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2755 - DNA, 31 bp, Artificial Sequence; identical to SEQ ID NO: 2713
  Pan degenerate oligonucleotide primer
  primer_bind (1)..(31)
  modified_base (1)..(1): base is a locked nucleic acid
  modified_base (3)..(3): base is a locked nucleic acid
  modified_base (4)..(4): base is a locked nucleic acid
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2756 - DNA, 31 bp, Artificial Sequence; identical to SEQ ID NO: 2714
  Pan degenerate oligonucleotide primer
  primer_bind (1)..(31)
  modified_base (1)..(1): base is a locked nucleic acid
  modified_base (3)..(3): base is a locked nucleic acid
  modified_base (5)..(5): base is a locked nucleic acid
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2757 - DNA, 31 bp, Artificial Sequence; identical to SEQ ID NO: 2713
  Pan degenerate oligonucleotide primer
  primer_bind (1)..(31)
  modified_base (1)..(1): base is a locked nucleic acid
  modified_base (2)..(2): base is a locked nucleic acid
  modified_base (3)..(3): base is a locked nucleic acid
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2758 - DNA, 31 bp, Artificial Sequence; identical to SEQ ID NO: 2714
  Pan degenerate oligonucleotide primer
  primer_bind (1)..(31)
  modified_base (1)..(1): base is a locked nucleic acid
  modified_base (2)..(2): base is a locked nucleic acid
  modified_base (3)..(3): base is a locked nucleic acid
  misc_feature (25)..(31): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2759 - DNA, 33 bp, Artificial Sequence; identical to SEQ ID NO: 2715
  Pan degenerate oligonucleotide primer
  primer_bind (1)..(33)
  modified_base (1)..(1): base is a locked nucleic acid
  modified_base (3)..(3): base is a locked nucleic acid
  modified_base (5)..(5): base is a locked nucleic acid
  misc_feature (27)..(33): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2760 - DNA, 32 bp, Artificial Sequence; identical to SEQ ID NO: 2716
  Pan degenerate oligonucleotide primer
  primer_bind (1)..(32)
  modified_base (1)..(1): base is a locked nucleic acid
  modified_base (2)..(2): base is a locked nucleic acid
  modified_base (4)..(4): base is a locked nucleic acid
  misc_feature (26)..(32): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2761 - DNA, 33 bp, Artificial Sequence; identical to SEQ ID NO: 2715
  Pan degenerate oligonucleotide primer
  primer_bind (1)..(33)
  modified_base (1)..(1): base is a locked nucleic acid
  modified_base (4)..(4): base is a locked nucleic acid
  modified_base (5)..(5): base is a locked nucleic acid
  misc_feature (27)..(33): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2762 - DNA, 32 bp, Artificial Sequence; identical to SEQ ID NO: 2716
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2763 - DNA, 33 bp, Artificial Sequence; identical to SEQ ID NO: 2715
  Pan degenerate oligonucleotide primer
  primer_bind (1)..(33)
  modified_base (1)..(1): base is a locked nucleic acid
  modified_base (3)..(3): base is a locked nucleic acid
  modified_base (4)..(4): base is a locked nucleic acid
  misc_feature (27)..(33): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2764 - DNA, 32 bp, Artificial Sequence; identical to SEQ ID NO: 2716
  Pan degenerate oligonucleotide primer
  primer_bind (1)..(32)
  modified_base (1)..(1): base is a locked nucleic acid
  modified_base (2)..(2): base is a locked nucleic acid
  modified_base (3)..(3): base is a locked nucleic acid
  misc_feature (26)..(32): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2765 - DNA, 40 bp, Artificial Sequence; identical to SEQ ID NO: 2709
  Pan degenerate oligonucleotide primer
  primer_bind (1)..(40)
  modified_base (1)..(1): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2766 - DNA, 40 bp, Artificial Sequence; identical to SEQ ID NO: 2710
  Pan degenerate oligonucleotide primer
  primer_bind (1)..(40)
  modified_base (5)..(5): base is a locked nucleic acid
  modified_base (6)..(6): base is a locked nucleic acid
  modified_base (7)..(7): base is a locked nucleic acid
  misc_feature (34)..(40): Adaptor region of the pan degenerate antisense primer that adapts the probe-binding site downstream of codon 227 to correspond to the nucleotides in an oligonucleotide probe downstream of the discriminating single nucleotide polymorphism.

SEQ ID NO: 2767 - DNA, 38 bp, Artificial Sequence
  Pan degenerate oligonucleotide primer
  primer_bind (1)..(38)
  misc_feature (32)..(38): Adaptor region of the pan degenerate antisense primer that adapts the probe-binding site downstream of codon 230 to correspond to the nucleotides in an oligonucleotide probe downstream of the discriminating single nucleotide polymorphism.
ytgkactgtccayttrtcaggatggagytcatahccca

SEQ ID NO: 2768 - DNA, 39 bp, Artificial Sequence
  Pan degenerate oligonucleotide primer
  primer_bind (1)..(39)
  misc_feature (33)..(39): Adaptor region of the pan degenerate antisense primer that adapts the probe-binding site downstream of codon 230 to correspond to the nucleotides in an oligonucleotide probe downstream of the discriminating single nucleotide polymorphism.
gytgkactgtccayttrtcaggatggagytcatahccca

SEQ ID NO: 2769 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.
ggytgkactgtccayttrtcaggatggagytcatahccca

SEQ ID NO: 2770 - DNA, 34 bp, Artificial Sequence
  Pan degenerate oligonucleotide primer
  primer_bind (1)..(34)
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.
actgtccayttrtcaggatggagytcatahccca

SEQ ID NO: 2771 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 230 to correspond to the nucleotides in an oligonucleotide probe downstream of the discriminating single nucleotide polymorphism.
kactgtccayttrtcaggatggagytcatahccca

SEQ ID NO: 2772 - DNA, 37 bp, Artificial Sequence
  Pan degenerate oligonucleotide primer
  primer_bind (1)..(37)
  misc_feature (31)..(37): Adaptor region of the pan degenerate antisense primer that adapts the probe-binding site downstream of codon 230 to correspond to the nucleotides in an oligonucleotide probe downstream of the discriminating single nucleotide polymorphism.
tgkactgtccayttrtcaggatggagytcatahccca

SEQ ID NO: 2773 - DNA, 50 bp, Artificial Sequence
  Pan degenerate oligonucleotide primer
  primer_bind (1)..(50)
  misc_feature (44)..(50): Adaptor region of the pan degenerate antisense primer that adapts the probe-binding site downstream of codon 230 to correspond to the nucleotides in an oligonucleotide probe downstream of the discriminating single nucleotide polymorphism.
ggyarywbtataggytgbactgtccayytrtcaggatggagytcataacc

SEQ ID NO: 2774 - DNA, 39 bp, Artificial Sequence
  Pan degenerate oligonucleotide primer
  primer_bind (1)..(39)
  misc_feature (32)..(38): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
ytgkactgtccayttrtcaggatggagytcatahcccan

SEQ ID NO: 2775 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
gytgkactgtccayttrtcaggatggagytcatahcccan

SEQ ID NO: 2776 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
ggytgkactgtccayttrtcaggatggagytcatahcccan

SEQ ID NO: 2777 - DNA, 35 bp, Artificial Sequence
  Pan degenerate oligonucleotide primer
  primer_bind (1)..(35)
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (35)..(35): base is a locked nucleic acid
  misc_feature (35)..(35): n is a, c, g, or t
actgtccayttrtcaggatggagytcatahcccan

SEQ ID NO: 2778 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
kactgtccayttrtcaggatggagytcatahcccan

SEQ ID NO: 2779 - DNA, 38 bp, Artificial Sequence
  Pan degenerate oligonucleotide primer
  primer_bind (1)..(38)
  misc_feature (31)..(37): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
tgkactgtccayttrtcaggatggagytcatahcccan

SEQ ID NO: 2780 - DNA, 51 bp, Artificial Sequence
  Pan degenerate oligonucleotide primer
  primer_bind (1)..(51)
  misc_feature (44)..(50): Adaptor region of the pan degenerate antisense primer that adapts the probe-binding site downstream of codon 230 to correspond to the nucleotides in an oligonucleotide probe downstream of the discriminating single nucleotide polymorphism.
  modified_base (51)..(51): base is a locked nucleic acid
  misc_feature (51)..(51): n is a, c, g, or t
ggyarywbtataggytgbactgtccayytrtcaggatggagytcataaccn

SEQ ID NO: 2781 - DNA, 38 bp, Artificial Sequence; identical to SEQ ID NO: 2767
  Pan degenerate oligonucleotide primer
  primer_bind (1)..(38)
  modified_base (1)..(1): base is a locked nucleic acid
  modified_base (2)..(2): base is a locked nucleic acid
  modified_base (5)..(5): base is a locked nucleic acid
  misc_feature (32)..(38): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2782 - DNA, 38 bp, Artificial Sequence; identical to SEQ ID NO: 2767
  Pan degenerate oligonucleotide primer
  primer_bind (1)..(38)
  modified_base (1)..(1): base is a locked nucleic acid
  modified_base (4)..(4): base is a locked nucleic acid
  modified_base (5)..(5): base is a locked nucleic acid
  misc_feature (32)..(38): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2783 - DNA, 38 bp, Artificial Sequence; identical to SEQ ID NO: 2767
  Pan degenerate oligonucleotide primer
  primer_bind (1)..(38)
  modified_base (1)..(1): base is a locked nucleic acid
  modified_base (2)..(2): base is a locked nucleic acid
  modified_base (4)..(4): base is a locked nucleic acid
  misc_feature (32)..(38): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2784 - DNA, 39 bp, Artificial Sequence; identical to SEQ ID NO: 2768
  Pan degenerate oligonucleotide primer
  primer_bind (1)..(39)
  modified_base (1)..(1): base is a locked nucleic acid
  modified_base (2)..(2): base is a locked nucleic acid
  modified_base (5)..(5): base is a locked nucleic acid
  misc_feature (33)..(39): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2785 - DNA, 39 bp, Artificial Sequence; identical to SEQ ID NO: 2768
  Pan degenerate oligonucleotide primer
  primer_bind (1)..(39)
  modified_base (1)..(1): base is a locked nucleic acid
  modified_base (3)..(3): base is a locked nucleic acid
  modified_base (5)..(5): base is a locked nucleic acid
  misc_feature (33)..(39): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2786 - DNA, 39 bp, Artificial Sequence; identical to SEQ ID NO: 2768
  Pan degenerate oligonucleotide primer
  primer_bind (1)..(39)
  modified_base (1)..(1): base is a locked nucleic acid
  modified_base (2)..(2): base is a locked nucleic acid
  modified_base (3)..(3): base is a locked nucleic acid
  misc_feature (33)..(39): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2787 - DNA, 40 bp, Artificial Sequence; identical to SEQ ID NO: 2769
  Pan degenerate oligonucleotide primer
  primer_bind (1)..(40)
  modified_base (2)..(2): base is a locked nucleic acid
  modified_base (3)..(3): base is a locked nucleic acid
  modified_base (6)..(6): base is a locked nucleic acid
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2788 - DNA, 40 bp, Artificial Sequence; identical to SEQ ID NO: 2769
  Pan degenerate oligonucleotide primer
  primer_bind (1)..(40)
  modified_base (3)..(3): base is a locked nucleic acid
  modified_base (4)..(4): base is a locked nucleic acid
  modified_base (6)..(6): base is a locked nucleic acid
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2789 - DNA, 34 bp, Artificial Sequence; identical to SEQ ID NO: 2770
  Pan degenerate oligonucleotide primer
  primer_bind (1)..(34)
  modified_base (1)..(1): base is a locked nucleic acid
  modified_base (3)..(3): base is a locked nucleic acid
  modified_base (6)..(6): base is a locked nucleic acid
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2790 - DNA, 34 bp, Artificial Sequence; identical to SEQ ID NO: 2770
  Pan degenerate oligonucleotide primer
  primer_bind (1)..(34)
  modified_base (1)..(1): base is a locked nucleic acid
  modified_base (4)..(4): base is a locked nucleic acid
  modified_base (6)..(6): base is a locked nucleic acid
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2791 - DNA, 34 bp, Artificial Sequence; identical to SEQ ID NO: 2770
  Pan degenerate oligonucleotide primer
  primer_bind (1)..(34)
  modified_base (1)..(1): base is a locked nucleic acid
  modified_base (3)..(3): base is a locked nucleic acid
  modified_base (4)..(4): base is a locked nucleic acid
  misc_feature (28)..(34): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2792 - DNA, 35 bp, Artificial Sequence; identical to SEQ ID NO: 2771
  Pan degenerate oligonucleotide primer
  primer_bind (1)..(35)
  modified_base (1)..(1): base is a locked nucleic acid
  modified_base (2)..(2): base is a locked nucleic acid
  modified_base (5)..(5): base is a locked nucleic acid
  misc_feature (29)..(35): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2793 - DNA, 35 bp, Artificial Sequence; identical to SEQ ID NO: 2771
  Pan degenerate oligonucleotide primer
  primer_bind (1)..(35)
  modified_base (1)..(1): base is a locked nucleic acid
  modified_base (4)..(4): base is a locked nucleic acid
  modified_base (5)..(5): base is a locked nucleic acid
  misc_feature (29)..(35): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2794 - DNA, 35 bp, Artificial Sequence; identical to SEQ ID NO: 2771
  Pan degenerate oligonucleotide primer
  primer_bind (1)..(35)
  modified_base (1)..(1): base is a locked nucleic acid
  modified_base (2)..(2): base is a locked nucleic acid
  modified_base (4)..(4): base is a locked nucleic acid
  misc_feature (29)..(35): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2795 - DNA, 37 bp, Artificial Sequence; identical to SEQ ID NO: 2772
  Pan degenerate oligonucleotide primer
  primer_bind (1)..(37)
  modified_base (1)..(1): base is a locked nucleic acid
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2796 - DNA, 37 bp, Artificial Sequence; identical to SEQ ID NO: 2772
  Pan degenerate oligonucleotide primer
  primer_bind (1)..(37)
  modified_base (1)..(1): base is a locked nucleic acid
  modified_base (4)..(4): base is a locked nucleic acid
  modified_base (6)..(6): base is a locked nucleic acid
  misc_feature (31)..(37): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2797 - DNA, 37 bp, Artificial Sequence; identical to SEQ ID NO: 2772
  Pan degenerate oligonucleotide primer
  primer_bind (1)..(37)
  modified_base (1)..(1): base is a locked nucleic acid
  modified_base (3)..(3): base is a locked nucleic acid
  modified_base (4)..(4): base is a locked nucleic acid
  misc_feature (31)..(37): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2798 - DNA, 40 bp, Artificial Sequence; identical to SEQ ID NO: 2769
  Pan degenerate oligonucleotide primer
  primer_bind (1)..(40)
  modified_base (1)..(1): base is a locked nucleic acid
  modified_base (2)..(2): base is a locked nucleic acid
  modified_base (3)..(3): base is a locked nucleic acid
  misc_feature (34)..(40): Adaptor region of the pan degenerate antisense primer that adapts the probe-binding site downstream of codon 230 to correspond to the nucleotides in an oligonucleotide probe downstream of the discriminating single nucleotide polymorphism.

SEQ ID NO: 2799 - DNA, 37 bp, Artificial Sequence
  Pan degenerate oligonucleotide primer
  primer_bind (1)..(37)
  misc_feature (1)..(1): n is a, c, g, or t
  misc_feature (31)..(37): Adaptor region of the pan degenerate antisense primer that adapts the probe-binding site downstream of codon 238 to correspond to the nucleotides in an oligonucleotide probe downstream of the discriminating single nucleotide polymorphism.
ntcyttdtctggyarywbtataggytgkactgtccay

SEQ ID NO: 2800 - DNA, 38 bp, Artificial Sequence
  Pan degenerate oligonucleotide primer
  primer_bind (1)..(38)
  misc_feature (2)..(2): n is a, c, g, or t
  misc_feature (32)..(38): Adaptor region of the pan degenerate antisense primer that adapts the probe-binding site downstream of codon 238 to correspond to the nucleotides in an oligonucleotide probe downstream of the discriminating single nucleotide polymorphism.
tntcyttdtctggyarywbtataggytgkactgtccay

SEQ ID NO: 2801 - DNA, 40 bp, Artificial Sequence
  Pan degenerate oligonucleotide primer
  primer_bind (1)..(40)
  misc_feature (4)..(4): n is a, c, g, or t
  misc_feature (34)..(40): Adaptor region of the pan degenerate antisense primer that adapts the probe-binding site downstream of codon 238 to correspond to the nucleotides in an oligonucleotide probe downstream of the discriminating single nucleotide polymorphism.
gctntcyttdtctggyarywbtataggytgkactgtccay

SEQ ID NO: 2802 - DNA, 32 bp, Artificial Sequence
  Pan degenerate oligonucleotide primer
  primer_bind (1)..(32)
  misc_feature (26)..(32): Adaptor region of the pan degenerate antisense primer that adapts the probe-binding site downstream of codon 238 to correspond to the nucleotides in an oligonucleotide probe downstream of the discriminating single nucleotide polymorphism.
tdtctggyarywbtataggytgkactgtccay

SEQ ID NO: 2803 - DNA, 35 bp, Artificial Sequence
  Pan degenerate oligonucleotide primer
  primer_bind (1)..(35)
  misc_feature (29)..(35): Adaptor region of the pan degenerate antisense primer that adapts the probe-binding site downstream of codon 238 to correspond to the nucleotides in an oligonucleotide probe downstream of the discriminating single nucleotide polymorphism.
cyttdtctggyarywbtataggytgkactgtccay

SEQ ID NO: 2804 - DNA, 36 bp, Artificial Sequence
  Pan degenerate oligonucleotide primer
  primer_bind (1)..(36)
  misc_feature (30)..(36): Adaptor region of the pan degenerate antisense primer that adapts the probe-binding site downstream of codon 238 to correspond to the nucleotides in an oligonucleotide probe downstream of the discriminating single nucleotide polymorphism.
tcyttdtctggyarywbtataggytgkactgtccay

SEQ ID NO: 2805 - DNA, 51 bp, Artificial Sequence
  Pan degenerate oligonucleotide primer
  primer_bind (1)..(51)
  misc_feature (45)..(51): Adaptor region of the pan degenerate antisense primer that adapts the probe-binding site downstream of codon 238 to correspond to the nucleotides in an oligonucleotide probe downstream of the discriminating single nucleotide polymorphism.
attgacagtccagctdtcyttktctggyarywbtataggytgbactgtcca

SEQ ID NO: 2806 - DNA, 38 bp, Artificial Sequence
  Pan degenerate oligonucleotide primer
  primer_bind (1)..(38)
  misc_feature (1)..(1): n is a, c, g, or t
  misc_feature (31)..(37): Adaptor region of the pan degenerate antisense primer that adapts the probe-binding site downstream of codon 238 to correspond to the nucleotides in an oligonucleotide probe downstream of the discriminating single nucleotide polymorphism.
  modified_base (38)..(38): base is a locked nucleic acid
  misc_feature (38)..(38): n is a, c, g, or t
ntcyttdtctggyarywbtataggytgkactgtccayn

SEQ ID NO: 2807 - DNA, 39 bp, Artificial Sequence
  Pan degenerate oligonucleotide primer
  primer_bind (1)..(39)
  misc_feature (2)..(2): n is a, c, g, or t
  misc_feature (32)..(38): Adaptor region of the pan degenerate antisense primer that adapts the probe-binding site downstream of codon 238 to correspond to the nucleotides in an oligonucleotide probe downstream of the discriminating single nucleotide polymorphism.
  modified_base (39)..(39): base is a locked nucleic acid
  misc_feature (39)..(39): n is a, c, g, or t
tntcyttdtctggyarywbtataggytgkactgtccayn

SEQ ID NO: 2808 - DNA, 41 bp, Artificial Sequence
  Pan degenerate oligonucleotide primer
  primer_bind (1)..(41)
  misc_feature (4)..(4): n is a, c, g, or t
  misc_feature (34)..(40): Adaptor region of the pan degenerate antisense primer that adapts the probe-binding site downstream of codon 238 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gctntcyttdtctggyarywbtataggytgkactgtccayn

SEQ ID NO: 2809 - DNA, 33 bp, Artificial Sequence
  Pan degenerate oligonucleotide primer
  primer_bind (1)..(33)
  misc_feature (26)..(32): Adaptor region of the pan degenerate antisense primer that adapts the probe-binding site downstream of codon 238 to correspond to the nucleotides in an oligonucleotide probe downstream of the discriminating single nucleotide polymorphism.
  modified_base (33)..(33): base is a locked nucleic acid
  misc_feature (33)..(33): n is a, c, g, or t
tdtctggyarywbtataggytgkactgtccayn

SEQ ID NO: 2810 - DNA, 36 bp, Artificial Sequence
  Pan degenerate oligonucleotide primer
  primer_bind (1)..(36)
  misc_feature (29)..(35): Adaptor region of the pan degenerate antisense primer that adapts the probe-binding site downstream of codon 238 to correspond to the nucleotides in an oligonucleotide probe downstream of the discriminating single nucleotide polymorphism.
  modified_base (36)..(36): base is a locked nucleic acid
  misc_feature (36)..(36): n is a, c, g, or t
cyttdtctggyarywbtataggytgkactgtccayn

SEQ ID NO: 2811 - DNA, 37 bp, Artificial Sequence
  Pan degenerate oligonucleotide primer
  primer_bind (1)..(37)
  misc_feature (30)..(36): Adaptor region of the pan degenerate antisense primer that adapts the probe-binding site downstream of codon 238 to correspond to the nucleotides in an oligonucleotide probe downstream of the discriminating single nucleotide polymorphism.
  modified_base (37)..(37): base is a locked nucleic acid
  misc_feature (37)..(37): n is a, c, g, or t
tcyttdtctggyarywbtataggytgkactgtccayn

SEQ ID NO: 2812 - DNA, 52 bp, Artificial Sequence
  Pan degenerate oligonucleotide primer
  primer_bind (1)..(52)
  misc_feature (45)..(51): Adaptor region of the pan degenerate antisense primer that adapts the probe-binding site downstream of codon 238 to correspond to the nucleotides in an oligonucleotide probe downstream of the discriminating single nucleotide polymorphism.
  modified_base (52)..(52): base is a locked nucleic acid
  misc_feature (52)..(52): n is a, c, g, or t
attgacagtccagctdtcyttktctggyarywbtataggytgbactgtccan

SEQ ID NO: 2813 - DNA, 37 bp, Artificial Sequence; identical to SEQ ID NO: 2799
  Pan degenerate oligonucleotide primer
  primer_bind (1)..(37)
  modified_base (1)..(1): base is a locked nucleic acid
  misc_feature (1)..(1): n is a, c, g, or t
  modified_base (2)..(2): base is a locked nucleic acid
  modified_base (6)..(6): base is a locked nucleic acid
  misc_feature (31)..(37): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2814 - DNA, 37 bp, Artificial Sequence; identical to SEQ ID NO: 2799
  Pan degenerate oligonucleotide primer
  primer_bind (1)..(37)
  modified_base (1)..(1): base is a locked nucleic acid
  misc_feature (1)..(1): n is a, c, g, or t
  modified_base (3)..(3): base is a locked nucleic acid
  modified_base (6)..(6): base is a locked nucleic acid
  misc_feature (31)..(37): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2815 - DNA, 37 bp, Artificial Sequence; identical to SEQ ID NO: 2799
  Pan degenerate oligonucleotide primer
  primer_bind (1)..(37)
  modified_base (1)..(1): base is a locked nucleic acid
  misc_feature (1)..(1): n is a, c, g, or t
  modified_base (2)..(2): base is a locked nucleic acid
  modified_base (3)..(3): base is a locked nucleic acid
  misc_feature (31)..(37): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2816 - DNA, 38 bp, Artificial Sequence; identical to SEQ ID NO: 2800
  Pan degenerate oligonucleotide primer
  primer_bind (1)..(38)
  modified_base (1)..(1): base is a locked nucleic acid
  modified_base (2)..(2): base is a locked nucleic acid
  misc_feature (2)..(2): n is a, c, g, or t
  modified_base (4)..(4): base is a locked nucleic acid
  misc_feature (32)..(38): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2817 - DNA, 38 bp, Artificial Sequence; identical to SEQ ID NO: 2800
  Pan degenerate oligonucleotide primer
  primer_bind (1)..(38)
  modified_base (1)..(1): base is a locked nucleic acid
  misc_feature (2)..(2): n is a, c, g, or t
  modified_base (3)..(3): base is a locked nucleic acid
  modified_base (4)..(4): base is a locked nucleic acid
  misc_feature (32)..(38): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2818 - DNA, 38 bp, Artificial Sequence; identical to SEQ ID NO: 2800
  Pan degenerate oligonucleotide primer
  primer_bind (1)..(38)
  modified_base (1)..(1): base is a locked nucleic acid
  modified_base (2)..(2): base is a locked nucleic acid
  misc_feature (2)..(2): n is a, c, g, or t
  modified_base (3)..(3): base is a locked nucleic acid
  misc_feature (32)..(38): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2819 - DNA, 40 bp, Artificial Sequence; identical to SEQ ID NO: 2801
  Pan degenerate oligonucleotide primer
  primer_bind (1)..(40)
  modified_base (2)..(2): base is a locked nucleic acid
  modified_base (3)..(3): base is a locked nucleic acid
  misc_feature (4)..(4): n is a, c, g, or t
  modified_base (5)..(5): base is a locked nucleic acid
  misc_feature (34)..(40): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2820 - DNA, 40 bp, Artificial Sequence; identical to SEQ ID NO: 2801
  Pan degenerate oligonucleotide primer
  primer_bind (1)..(40)
  modified_base (2)..(2): base is a locked nucleic acid
  modified_base (4)..(4): base is a locked nucleic acid
  misc_feature (4)..(4): n is a, c, g, or t
  modified_base (5)..(5): base is a locked nucleic acid
  misc_feature (34)..(40): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2821 - DNA, 32 bp, Artificial Sequence; identical to SEQ ID NO: 2802
  Pan degenerate oligonucleotide primer
  primer_bind (1)..(32)
  modified_base (1)..(1): base is a locked nucleic acid
  modified_base (3)..(3): base is a locked nucleic acid
  modified_base (10)..(10): base is a locked nucleic acid
  misc_feature (26)..(32): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2822 - DNA, 32 bp, Artificial Sequence; identical to SEQ ID NO: 2802
  Pan degenerate oligonucleotide primer
  primer_bind (1)..(32)
  modified_base (1)..(1): base is a locked nucleic acid
  modified_base (4)..(4): base is a locked nucleic acid
  modified_base (10)..(10): base is a locked nucleic acid
  misc_feature (26)..(32): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2823 - DNA, 32 bp, Artificial Sequence; identical to SEQ ID NO: 2802
  Pan degenerate oligonucleotide primer
  primer_bind (1)..(32)
  modified_base (1)..(1): base is a locked nucleic acid
  modified_base (3)..(3): base is a locked nucleic acid
  modified_base (4)..(4): base is a locked nucleic acid
  misc_feature (26)..(32): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2824 - DNA, 35 bp, Artificial Sequence; identical to SEQ ID NO: 2803
  Pan degenerate oligonucleotide primer
  primer_bind (1)..(35)
  modified_base (1)..(1): base is a locked nucleic acid
  modified_base (4)..(4): base is a locked nucleic acid
  modified_base (7)..(7): base is a locked nucleic acid
  misc_feature (29)..(35): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2825 - DNA, 35 bp, Artificial Sequence; identical to SEQ ID NO: 2803
  Pan degenerate oligonucleotide primer
  primer_bind (1)..(35)
  modified_base (1)..(1): base is a locked nucleic acid
  modified_base (6)..(6): base is a locked nucleic acid
  modified_base (7)..(7): base is a locked nucleic acid
  misc_feature (29)..(35): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2826 - DNA, 35 bp, Artificial Sequence; identical to SEQ ID NO: 2803
  Pan degenerate oligonucleotide primer
  primer_bind (1)..(35)
  modified_base (1)..(1): base is a locked nucleic acid
  modified_base (4)..(4): base is a locked nucleic acid
  modified_base (6)..(6): base is a locked nucleic acid
  misc_feature (29)..(35): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2827 - DNA, 36 bp, Artificial Sequence; identical to SEQ ID NO: 2804
  Pan degenerate oligonucleotide primer
  primer_bind (1)..(36)
  modified_base (1)..(1): base is a locked nucleic acid
  modified_base (2)..(2): base is a locked nucleic acid
  modified_base (7)..(7): base is a locked nucleic acid
  misc_feature (30)..(36): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2828 - DNA, 36 bp, Artificial Sequence; identical to SEQ ID NO: 2804
  Pan degenerate oligonucleotide primer
  primer_bind (1)..(36)
  modified_base (1)..(1): base is a locked nucleic acid
  modified_base (5)..(5): base is a locked nucleic acid
  modified_base (7)..(7): base is a locked nucleic acid
  misc_feature (30)..(36): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2829 - DNA, 36 bp, Artificial Sequence; identical to SEQ ID NO: 2804
  Pan degenerate oligonucleotide primer
  primer_bind (1)..(36)
  modified_base (1)..(1): base is a locked nucleic acid
  modified_base (2)..(2): base is a locked nucleic acid
  modified_base (5)..(5): base is a locked nucleic acid
  misc_feature (30)..(36): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2830 - DNA, 40 bp, Artificial Sequence; identical to SEQ ID NO: 2801
  Pan degenerate oligonucleotide primer
  primer_bind (1)..(40)
  modified_base (2)..(2): base is a locked nucleic acid
  modified_base (3)..(3): base is a locked nucleic acid
  modified_base (4)..(4): base is a locked nucleic acid
  misc_feature (4)..(4): n is a, c, g, or t
  misc_feature (34)..(40): Adaptor region of the pan degenerate antisense primer that adapts the probe-binding site downstream of codon 238 to correspond to the nucleotides in an oligonucleotide probe downstream of the discriminating single nucleotide polymorphism.

SEQ ID NO: 2831 - DNA, 33 bp, Artificial Sequence
  Pan degenerate oligonucleotide primer
  primer_bind (1)..(33)
  misc_feature (27)..(33): Adaptor region of the pan degenerate antisense primer that adapts the probe-binding site downstream of codon 318 to correspond to the nucleotides in an oligonucleotide probe downstream of the discriminating single nucleotide polymorphism.
tayytcwgctayyaadtcttttgwtggrtcata

SEQ ID NO: 2832 - DNA, 39 bp, Artificial Sequence
  Pan degenerate oligonucleotide primer
  primer_bind (1)..(39)
  misc_feature (33)..(39): Adaptor region of the pan degenerate antisense primer that adapts the probe-binding site downstream of codon 318 to correspond to the nucleotides in an oligonucleotide probe downstream of the discriminating single nucleotide polymorphism.
yttytgtayytcwgctayyaadtcttttgwtggrtcata

SEQ ID NO: 2833 - DNA, 40 bp, Artificial Sequence
  Pan degenerate oligonucleotide primer
  primer_bind (1)..(40)
  misc_feature (34)..(40): Adaptor region of the pan degenerate antisense primer that adapts the probe-binding site downstream of codon 318 to correspond to the nucleotides in an oligonucleotide probe downstream of the discriminating single nucleotide polymorphism.
gyttytgtayytcwgctayyaadtcttttgwtggrtcata

SEQ ID NO: 2834 - DNA, 52 bp, Artificial Sequence
  Pan degenerate oligonucleotide primer
  primer_bind (1)..(52)
  misc_feature (46)..(52): Adaptor region of the pan degenerate antisense primer that adapts the probe-binding site downstream of codon 318 to correspond to the nucleotides in an oligonucleotide probe downstream of the discriminating single nucleotide polymorphism.
ychwbyccytgyttytgtabttcwgctayyaadtcttttgwtggrtcataat

SEQ ID NO: 2835 - DNA, 34 bp, Artificial Sequence
  Pan degenerate oligonucleotide primer
  primer_bind (1)..(34)
  misc_feature (27)..(33): Adaptor region of the pan degenerate antisense primer that adapts the probe-binding site downstream of codon 318 to correspond to the nucleotides in an oligonucleotide probe downstream of the discriminating single nucleotide polymorphism.
  modified_base (34)..(34): base is a locked nucleic acid
  misc_feature (34)..(34): n is a, c, g, or t
tayytcwgctayyaadtcttttgwtggrtcatan

SEQ ID NO: 2836 - DNA, 40 bp, Artificial Sequence
  Pan degenerate oligonucleotide primer
  primer_bind (1)..(40)
  misc_feature (33)..(39): Adaptor region of the pan degenerate antisense primer that adapts the probe-binding site downstream of codon 318 to correspond to the nucleotides in an oligonucleotide probe downstream of the discriminating single nucleotide polymorphism.
  modified_base (40)..(40): base is a locked nucleic acid
  misc_feature (40)..(40): n is a, c, g, or t
yttytgtayytcwgctayyaadtcttttgwtggrtcatan

SEQ ID NO: 2837 - DNA, 41 bp, Artificial Sequence
  Pan degenerate oligonucleotide primer
  primer_bind (1)..(41)
  misc_feature (34)..(40): Adaptor region of the pan degenerate antisense primer that adapts the probe-binding site downstream of codon 318 to correspond to the nucleotides in an oligonucleotide probe downstream of the discriminating single nucleotide polymorphism.
  modified_base (41)..(41): base is a locked nucleic acid
  misc_feature (41)..(41): n is a, c, g, or t
gyttytgtayytcwgctayyaadtcttttgwtggrtcatan

SEQ ID NO: 2838 - DNA, 53 bp, Artificial Sequence
  Pan degenerate oligonucleotide primer
  primer_bind (1)..(53)
  misc_feature (46)..(52): Adaptor region of the pan degenerate antisense primer that adapts the probe-binding site downstream of codon 318 to correspond to the nucleotides in an oligonucleotide probe downstream of the discriminating single nucleotide polymorphism.
  modified_base (53)..(53): base is a locked nucleic acid
  misc_feature (53)..(53): n is a, c, g, or t
ychwbyccytgyttytgtabttcwgctayyaadtcttttgwtggrtcataatn

SEQ ID NO: 2839 - DNA, 33 bp, Artificial Sequence; identical to SEQ ID NO: 2831
  Pan degenerate oligonucleotide primer
  primer_bind (1)..(33)
  modified_base (1)..(1): base is a locked nucleic acid
  misc_feature (27)..(33): Adaptor region of the pan degenerate antisense primer that adapts the probe-binding site downstream of codon 318 to correspond to the nucleotides in an oligonucleotide probe downstream of the discriminating single nucleotide polymorphism.

SEQ ID NO: 2840 - DNA, 39 bp, Artificial Sequence; identical to SEQ ID NO: 2832
  Pan degenerate oligonucleotide primer
  primer_bind (1)..(39)
  modified_base (1)..(1): base is a locked nucleic acid
  modified_base (7)..(7): base is a locked nucleic acid
  misc_feature (33)..(39): Adaptor region of the pan degenerate antisense primer that adapts the probe-binding site downstream of codon 318 to correspond to the nucleotides in an oligonucleotide probe downstream of the discriminating single nucleotide polymorphism.

SEQ ID NO: 2841 - DNA, 39 bp, Artificial Sequence; identical to SEQ ID NO: 2832
  Pan degenerate oligonucleotide primer
  primer_bind (1)..(39)
  modified_base (1)..(1): base is a locked nucleic acid
  misc_feature (33)..(39): Adaptor region of the pan degenerate antisense primer that adapts the probe-binding site downstream of codon 318 to correspond to the nucleotides in an oligonucleotide probe downstream of the discriminating single nucleotide polymorphism.

SEQ ID NO: 2842 - DNA, 40 bp, Artificial Sequence; identical to SEQ ID NO: 2833
  Pan degenerate oligonucleotide primer
  primer_bind (1)..(40)
  modified_base (2)..(2): base is a locked nucleic acid
  modified_base (8)..(8): base is a locked nucleic acid
  misc_feature (34)..(40): Adaptor region of the pan degenerate antisense primer that adapts the probe-binding site downstream of codon 318 to correspond to the nucleotides in an oligonucleotide probe downstream of the discriminating single nucleotide polymorphism.

SEQ ID NO: 2843 - DNA, 40 bp, Artificial Sequence; identical to SEQ ID NO: 2833
  Pan degenerate oligonucleotide primer
  primer_bind (1)..(40)
  modified_base (8)..(8): base is a locked nucleic acid
  misc_feature (34)..(40): Adaptor region of the pan degenerate antisense primer that adapts the probe-binding site downstream of codon 318 to correspond to the nucleotides in an oligonucleotide probe downstream of the discriminating single nucleotide polymorphism.

SEQ ID NO: 2844 - DNA, 40 bp, Artificial Sequence; identical to SEQ ID NO: 2833
  Pan degenerate oligonucleotide primer
  primer_bind (1)..(40)
  modified_base (1)..(1): base is a locked nucleic acid
  modified_base (2)..(2): base is a locked nucleic acid
  modified_base (8)..(8): base is a locked nucleic acid
  misc_feature (34)..(40): Adaptor region of the pan degenerate antisense primer that adapts the probe-binding site downstream of codon 318 to correspond to the nucleotides in an oligonucleotide probe downstream of the discriminating single nucleotide polymorphism.

SEQ ID NO: 2845 - DNA, 15 bp, Artificial Sequence
  Oligonucleotide probe
  misc_binding (1)..(15): Hybridization probe for the specific detection of wild-type HIV-1 at codon 40 of the reverse transcriptase gene.
tgtacagaratggaa

SEQ ID NO: 2846 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (15)..(15): base is a locked nucleic acid
tgtrmdgadatggarrarg

SEQ ID NO: 2847 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (11)..(11): base is a locked nucleic acid
tgtrmdgadatggarrarg

SEQ ID NO: 2848 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (17)..(17): base is a locked nucleic acid
tgtrmdgadatggarrarg

SEQ ID NO: 2849 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (13)..(13): base is a locked nucleic acid
tgtrmdgadatggarrarg

SEQ ID NO: 2850 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (3)..(3): base is a locked nucleic acid
tgtrmdgadatggarrarg

SEQ ID NO: 2851 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (8)..(8): base is a locked nucleic acid
tgtrmdgadatggarrarg

SEQ ID NO: 2852 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (5)..(5): base is a locked nucleic acid
tgtrmdgadatggarrarg

SEQ ID NO: 2853 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (7)..(7): base is a locked nucleic acid
tgtrmdgadatggarrarg

SEQ ID NO: 2854 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (9)..(9): base is a locked nucleic acid
  modified_base (11)..(11): base is a locked nucleic acid
  modified_base (16)..(16): base is a locked nucleic acid
tgtrmdgadatggarrarg

SEQ ID NO: 2855 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (9)..(9): base is a locked nucleic acid
  modified_base (11)..(11): base is a locked nucleic acid
  modified_base (14)..(14): base is a locked nucleic acid
tgtrmdgadatggarrarg

SEQ ID NO: 2856 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (9)..(9): base is a locked nucleic acid
  modified_base (11)..(11): base is a locked nucleic acid
  modified_base (17)..(17): base is a locked nucleic acid
tgtrmdgadatggarrarg

SEQ ID NO: 2857 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (9)..(9): base is a locked nucleic acid
  modified_base (11)..(11): base is a locked nucleic acid
  modified_base (18)..(18): base is a locked nucleic acid
tgtrmdgadatggarrarg

SEQ ID NO: 2858 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (3)..(3): base is a locked nucleic acid
  modified_base (9)..(9): base is a locked nucleic acid
  modified_base (11)..(11): base is a locked nucleic acid
tgtrmdgadatggarrarg

SEQ ID NO: 2859 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (2)..(2): base is a locked nucleic acid
  modified_base (9)..(9): base is a locked nucleic acid
  modified_base (11)..(11): base is a locked nucleic acid
tgtrmdgadatggarrarg

SEQ ID NO: 2860 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (6)..(6): base is a locked nucleic acid
  modified_base (9)..(9): base is a locked nucleic acid
  modified_base (11)..(11): base is a locked nucleic acid
tgtrmdgadatggarrarg

SEQ ID NO: 2861 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (7)..(7): base is a locked nucleic acid
  modified_base (9)..(9): base is a locked nucleic acid
  modified_base (11)..(11): base is a locked nucleic acid
tgtrmdgadatggarrarg

SEQ ID NO: 2862 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
  modified_base (9)..(9): base is a locked nucleic acid
  modified_base (11)..(11): base is a locked nucleic acid
tgtrmdgadatggarrarg

SEQ ID NO: 2863 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (14)..(14): base is a locked nucleic acid
gtrmdgadatggarrar

SEQ ID NO: 2864 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (10)..(10): base is a locked nucleic acid
gtrmdgadatggarrar

SEQ ID NO: 2865 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (16)..(16): base is a locked nucleic acid
gtrmdgadatggarrar

SEQ ID NO: 2866 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (12)..(12): base is a locked nucleic acid
gtrmdgadatggarrar

SEQ ID NO: 2867 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (2)..(2): base is a locked nucleic acid
gtrmdgadatggarrar

SEQ ID NO: 2868 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (7)..(7): base is a locked nucleic acid
gtrmdgadatggarrar

SEQ ID NO: 2869 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (4)..(4): base is a locked nucleic acid
gtrmdgadatggarrar

SEQ ID NO: 2870 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (6)..(6): base is a locked nucleic acid
gtrmdgadatggarrar

SEQ ID NO: 2871 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
  modified_base (15)..(15): base is a locked nucleic acid
gtrmdgadatggarrar

SEQ ID NO: 2872 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
  modified_base (13)..(13): base is a locked nucleic acid
gtrmdgadatggarrar

SEQ ID NO: 2873 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
  modified_base (16)..(16): base is a locked nucleic acid
gtrmdgadatggarrar

SEQ ID NO: 2874 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
  modified_base (17)..(17): base is a locked nucleic acid
gtrmdgadatggarrar

SEQ ID NO: 2875 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (2)..(2): base is a locked nucleic acid
  modified_base (8)..(8): base is a locked nucleic acid
  modified_base (10)..(10): base is a locked nucleic acid
gtrmdgadatggarrar

SEQ ID NO: 2876 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (1)..(1): base is a locked nucleic acid
  modified_base (8)..(8): base is a locked nucleic acid
  modified_base (10)..(10): base is a locked nucleic acid
gtrmdgadatggarrar

SEQ ID NO: 2877 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (5)..(5): base is a locked nucleic acid
  modified_base (8)..(8): base is a locked nucleic acid
  modified_base (10)..(10): base is a locked nucleic acid
gtrmdgadatggarrar

SEQ ID NO: 2878 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (6)..(6): base is a locked nucleic acid
  modified_base (8)..(8): base is a locked nucleic acid
  modified_base (10)..(10): base is a locked nucleic acid
gtrmdgadatggarrar

SEQ ID NO: 2879 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
gtrmdgadatggarrar

SEQ ID NO: 2880 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (14)..(14): base is a locked nucleic acid
gtrmdgadatggarr

SEQ ID NO: 2881 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (10)..(10): base is a locked nucleic acid
gtrmdgadatggarr

SEQ ID NO: 2882 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
gtrmdgadatggarr

SEQ ID NO: 2883 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (12)..(12): base is a locked nucleic acid
gtrmdgadatggarr

SEQ ID NO: 2884 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (2)..(2): base is a locked nucleic acid
gtrmdgadatggarr

SEQ ID NO: 2885 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (7)..(7): base is a locked nucleic acid
gtrmdgadatggarr

SEQ ID NO: 2886 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (4)..(4): base is a locked nucleic acid
gtrmdgadatggarr

SEQ ID NO: 2887 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (6)..(6): base is a locked nucleic acid
gtrmdgadatggarr

SEQ ID NO: 2888 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
  modified_base (15)..(15): base is a locked nucleic acid
gtrmdgadatggarr

SEQ ID NO: 2889 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
  modified_base (13)..(13): base is a locked nucleic acid
gtrmdgadatggarr

SEQ ID NO: 2890 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
gtrmdgadatggarr

SEQ ID NO: 2891 - DNA, 16 bp, Artificial Sequence
  Oligonucleotide probe
  misc_binding (1)..(16): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
gtrmdgadatggarra

SEQ ID NO: 2892 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (2)..(2): base is a locked nucleic acid
  modified_base (8)..(8): base is a locked nucleic acid
  modified_base (10)..(10): base is a locked nucleic acid
gtrmdgadatggarr

SEQ ID NO: 2893 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (1)..(1): base is a locked nucleic acid
  modified_base (8)..(8): base is a locked nucleic acid
  modified_base (10)..(10): base is a locked nucleic acid
gtrmdgadatggarr

SEQ ID NO: 2894 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (5)..(5): base is a locked nucleic acid
  modified_base (8)..(8): base is a locked nucleic acid
  modified_base (10)..(10): base is a locked nucleic acid
gtrmdgadatggarr

SEQ ID NO: 2895 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (6)..(6): base is a locked nucleic acid
  modified_base (8)..(8): base is a locked nucleic acid
  modified_base (10)..(10): base is a locked nucleic acid
gtrmdgadatggarr

SEQ ID NO: 2896 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
gtrmdgadatggarr

SEQ ID NO: 2897 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
gtrmdgadatgga

SEQ ID NO: 2898 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (10)..(10): base is a locked nucleic acid
gtrmdgadatgga

SEQ ID NO: 2899 - DNA, 14 bp, Artificial Sequence
  Oligonucleotide probe
  misc_binding (1)..(14): Hybridization probe for the specific detection of wild-type HIV-1 at codon 41 of the reverse transcriptase gene.
gtrmdgadatggar

SEQ ID NO: 2900 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (12)..(12): base is a locked nucleic acid
gtrmdgadatgga

SEQ ID NO: 2901 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (2)..(2): base is a locked nucleic acid
gtrmdgadatgga

SEQ ID NO: 2902 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (7)..(7): base is a locked nucleic acid
gtrmdgadatgga

SEQ ID NO: 2903 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (4)..(4): base is a locked nucleic acid
gtrmdgadatgga

SEQ ID NO: 2904 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (6)..(6): base is a locked nucleic acid
gtrmdgadatgga

SEQ ID NO: 2905 - DNA, 14 bp, Artificial Sequence
  Oligonucleotide probe
  misc_binding (1)..(14): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
gtrmdgadatggar

SEQ ID NO: 2906 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
  modified_base (13)..(13): base is a locked nucleic acid
gtrmdgadatgga

SEQ ID NO: 2907 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (2)..(2): base is a locked nucleic acid
  modified_base (8)..(8): base is a locked nucleic acid
  modified_base (10)..(10): base is a locked nucleic acid
gtrmdgadatgga

SEQ ID NO: 2908 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (1)..(1): base is a locked nucleic acid
  modified_base (8)..(8): base is a locked nucleic acid
  modified_base (10)..(10): base is a locked nucleic acid
gtrmdgadatgga

SEQ ID NO: 2909 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (5)..(5): base is a locked nucleic acid
  modified_base (8)..(8): base is a locked nucleic acid
  modified_base (10)..(10): base is a locked nucleic acid
gtrmdgadatgga

SEQ ID NO: 2910 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (6)..(6): base is a locked nucleic acid
  modified_base (8)..(8): base is a locked nucleic acid
  modified_base (10)..(10): base is a locked nucleic acid
gtrmdgadatgga

SEQ ID NO: 2911 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
  modified_base (8)..(8): base is a locked nucleic acid
  modified_base (10)..(10): base is a locked nucleic acid
gtrmdgadatgga

SEQ ID NO: 2912 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
tacagaaatggaaaa

SEQ ID NO: 2913 - DNA, 19 bp, Artificial Sequence
  Oligonucleotide probe
  misc_binding (1)..(19): Hybridization probe for the specific detection of wild-type HIV-1 at codon 41 of the reverse transcriptase gene.
tgtrmdgadatggarrarg

SEQ ID NO: 2914 - DNA, 17 bp, Artificial Sequence
  Oligonucleotide probe
  misc_binding (1)..(17): Hybridization probe for the specific detection of wild-type HIV-1 at codon 41 of the reverse transcriptase gene.
gtrmdgadatggarrar

SEQ ID NO: 2915 - DNA, 15 bp, Artificial Sequence
  Oligonucleotide probe
  misc_binding (1)..(15): Hybridization probe for the specific detection of wild-type HIV-1 at codon 41 of the reverse transcriptase gene.
gtrmdgadatggarr

SEQ ID NO: 2916 - DNA, 16 bp, Artificial Sequence
  Oligonucleotide probe
  misc_binding (1)..(16): Hybridization probe for the specific detection of wild-type HIV-1 at codon 41 of the reverse transcriptase gene.
gtrmdgadatggarra

SEQ ID NO: 2917 - DNA, 13 bp, Artificial Sequence
  Oligonucleotide probe
  misc_binding (1)..(13): Hybridization probe for the specific detection of wild-type HIV-1 at codon 41 of the reverse transcriptase gene.
gtrmdgadatgga

SEQ ID NO: 2918 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (14)..(14): base is a locked nucleic acid
ggarrargarggraaaaty

SEQ ID NO: 2919 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (15)..(15): base is a locked nucleic acid
tggarrargaaggraaaat

SEQ ID NO: 2920 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (11)..(11): base is a locked nucleic acid
ggarrargarggraaaaty

SEQ ID NO: 2921 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (11)..(11): base is a locked nucleic acid
tggarrargaaggraaaat

SEQ ID NO: 2922 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (17)..(17): base is a locked nucleic acid
ggarrargarggraaaaty

SEQ ID NO: 2923 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (17)..(17): base is a locked nucleic acid
tggarrargaaggraaaat

SEQ ID NO: 2924 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (15)..(15): base is a locked nucleic acid
ggarrargarggraaaaty

SEQ ID NO: 2925 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (13)..(13): base is a locked nucleic acid
tggarrargaaggraaaat

SEQ ID NO: 2926 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (3)..(3): base is a locked nucleic acid
ggarrargarggraaaaty

SEQ ID NO: 2927 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (3)..(3): base is a locked nucleic acid
tggarrargaaggraaaat

SEQ ID NO: 2928 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (7)..(7): base is a locked nucleic acid
ggarrargarggraaaaty

SEQ ID NO: 2929 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (8)..(8): base is a locked nucleic acid
tggarrargaaggraaaat

SEQ ID NO: 2930 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (2)..(2): base is a locked nucleic acid
ggarrargarggraaaaty

SEQ ID NO: 2931 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (5)..(5): base is a locked nucleic acid
tggarrargaaggraaaat

SEQ ID NO: 2932 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (8)..(8): base is a locked nucleic acid
ggarrargarggraaaaty

SEQ ID NO: 2933 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (7)..(7): base is a locked nucleic acid
tggarrargaaggraaaat

SEQ ID NO: 2934 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (17)..(17): base is a locked nucleic acid
ggarrargarggraaaaty

SEQ ID NO: 2935 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (16)..(16): base is a locked nucleic acid
tggarrargaaggraaaat

SEQ ID NO: 2936 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (16)..(16): base is a locked nucleic acid
ggarrargarggraaaaty

SEQ ID NO: 2937 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (14)..(14): base is a locked nucleic acid
tggarrargaaggraaaat

SEQ ID NO: 2938 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (13)..(13): base is a locked nucleic acid
ggarrargarggraaaaty

SEQ ID NO: 2939 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (17)..(17): base is a locked nucleic acid
tggarrargaaggraaaat

SEQ ID NO: 2940 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (14)..(14): base is a locked nucleic acid
ggarrargarggraaaaty

SEQ ID NO: 2941 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
  modified_base (18)..(18): base is a locked nucleic acid
tggarrargaaggraaaat

SEQ ID NO: 2942 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (4)..(4): base is a locked nucleic acid
  modified_base (9)..(9): base is a locked nucleic acid
  modified_base (11)..(11): base is a locked nucleic acid
ggarrargarggraaaaty

SEQ ID NO: 2943 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (3)..(3): base is a locked nucleic acid
  modified_base (9)..(9): base is a locked nucleic acid
  modified_base (11)..(11): base is a locked nucleic acid
tggarrargaaggraaaat

SEQ ID NO: 2944 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (8)..(8): base is a locked nucleic acid
  modified_base (9)..(9): base is a locked nucleic acid
  modified_base (11)..(11): base is a locked nucleic acid
ggarrargarggraaaaty

SEQ ID NO: 2945 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (2)..(2): base is a locked nucleic acid
  modified_base (9)..(9): base is a locked nucleic acid
  modified_base (11)..(11): base is a locked nucleic acid
tggarrargaaggraaaat

SEQ ID NO: 2946 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (3)..(3): base is a locked nucleic acid
  modified_base (9)..(9): base is a locked nucleic acid
  modified_base (11)..(11): base is a locked nucleic acid
ggarrargarggraaaaty

SEQ ID NO: 2947 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (6)..(6): base is a locked nucleic acid
  modified_base (9)..(9): base is a locked nucleic acid
  modified_base (11)..(11): base is a locked nucleic acid
tggarrargaaggraaaat

SEQ ID NO: 2948 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (5)..(5): base is a locked nucleic acid
  modified_base (9)..(9): base is a locked nucleic acid
  modified_base (11)..(11): base is a locked nucleic acid
ggarrargarggraaaaty

SEQ ID NO: 2949 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (7)..(7): base is a locked nucleic acid
  modified_base (9)..(9): base is a locked nucleic acid
  modified_base (11)..(11): base is a locked nucleic acid
tggarrargaaggraaaat

SEQ ID NO: 2950 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
ggarrargarggraaaaty

SEQ ID NO: 2951 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
  modified_base (9)..(9): base is a locked nucleic acid
  modified_base (11)..(11): base is a locked nucleic acid
tggarrargaaggraaaat

SEQ ID NO: 2952 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (13)..(13): base is a locked nucleic acid
garrargarggraaaat

SEQ ID NO: 2953 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (14)..(14): base is a locked nucleic acid
ggarrargaaggraaaa

SEQ ID NO: 2954 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (10)..(10): base is a locked nucleic acid
garrargarggraaaat

SEQ ID NO: 2955 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (10)..(10): base is a locked nucleic acid
ggarrargaaggraaaa

SEQ ID NO: 2956 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (16)..(16): base is a locked nucleic acid
garrargarggraaaat

SEQ ID NO: 2957 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (16)..(16): base is a locked nucleic acid
ggarrargaaggraaaa

SEQ ID NO: 2958 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (14)..(14): base is a locked nucleic acid
garrargarggraaaat

SEQ ID NO: 2959 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (12)..(12): base is a locked nucleic acid
ggarrargaaggraaaa

SEQ ID NO: 2960 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (2)..(2): base is a locked nucleic acid
garrargarggraaaat

SEQ ID NO: 2961 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (2)..(2): base is a locked nucleic acid
ggarrargaaggraaaa

SEQ ID NO: 2962 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (6)..(6): base is a locked nucleic acid
garrargarggraaaat

SEQ ID NO: 2963 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (7)..(7): base is a locked nucleic acid
ggarrargaaggraaaa

SEQ ID NO: 2964 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (1)..(1): base is a locked nucleic acid
garrargarggraaaat

SEQ ID NO: 2965 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (4)..(4): base is a locked nucleic acid
ggarrargaaggraaaa

SEQ ID NO: 2966 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (7)..(7): base is a locked nucleic acid
garrargarggraaaat

SEQ ID NO: 2967 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (6)..(6): base is a locked nucleic acid
ggarrargaaggraaaa

SEQ ID NO: 2968 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (16)..(16): base is a locked nucleic acid
garrargarggraaaat

SEQ ID NO: 2969 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (15)..(15): base is a locked nucleic acid
ggarrargaaggraaaa

SEQ ID NO: 2970 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (15)..(15): base is a locked nucleic acid
garrargarggraaaat

SEQ ID NO: 2971 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (13)..(13): base is a locked nucleic acid
ggarrargaaggraaaa

SEQ ID NO: 2972 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (12)..(12): base is a locked nucleic acid
garrargarggraaaat

SEQ ID NO: 2973 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (16)..(16): base is a locked nucleic acid
ggarrargaaggraaaa

SEQ ID NO: 2974 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (13)..(13): base is a locked nucleic acid
garrargarggraaaat

SEQ ID NO: 2975 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (17)..(17): base is a locked nucleic acid
ggarrargaaggraaaa

SEQ ID NO: 2976 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (3)..(3): base is a locked nucleic acid
  modified_base (8)..(8): base is a locked nucleic acid
  modified_base (10)..(10): base is a locked nucleic acid
garrargarggraaaat

SEQ ID NO: 2977 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (2)..(2): base is a locked nucleic acid
  modified_base (8)..(8): base is a locked nucleic acid
  modified_base (10)..(10): base is a locked nucleic acid
ggarrargaaggraaaa

SEQ ID NO: 2978 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (7)..(7): base is a locked nucleic acid
  modified_base (8)..(8): base is a locked nucleic acid
  modified_base (10)..(10): base is a locked nucleic acid
garrargarggraaaat

SEQ ID NO: 2979 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (1)..(1): base is a locked nucleic acid
  modified_base (8)..(8): base is a locked nucleic acid
  modified_base (10)..(10): base is a locked nucleic acid
ggarrargaaggraaaa

SEQ ID NO: 2980 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (2)..(2): base is a locked nucleic acid
  modified_base (8)..(8): base is a locked nucleic acid
  modified_base (10)..(10): base is a locked nucleic acid
garrargarggraaaat

SEQ ID NO: 2981 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (5)..(5): base is a locked nucleic acid
  modified_base (8)..(8): base is a locked nucleic acid
  modified_base (10)..(10): base is a locked nucleic acid
ggarrargaaggraaaa

SEQ ID NO: 2982 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (4)..(4): base is a locked nucleic acid
  modified_base (8)..(8): base is a locked nucleic acid
  modified_base (10)..(10): base is a locked nucleic acid
garrargarggraaaat

SEQ ID NO: 2983 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (6)..(6): base is a locked nucleic acid
  modified_base (8)..(8): base is a locked nucleic acid
  modified_base (10)..(10): base is a locked nucleic acid
ggarrargaaggraaaa

SEQ ID NO: 2984 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
garrargarggraaaat

SEQ ID NO: 2985 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
ggarrargaaggraaaa

SEQ ID NO: 2986 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (13)..(13): base is a locked nucleic acid
garrargarggraaa

SEQ ID NO: 2987 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (14)..(14): base is a locked nucleic acid
ggarrargaaggraa

SEQ ID NO: 2988 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (10)..(10): base is a locked nucleic acid
garrargarggraaa

SEQ ID NO: 2989 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (10)..(10): base is a locked nucleic acid
ggarrargaaggraa

SEQ ID NO: 2990 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
garrargarggraaa

SEQ ID NO: 2991 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
ggarrargaaggraa

SEQ ID NO: 2992 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (14)..(14): base is a locked nucleic acid
garrargarggraaa

SEQ ID NO: 2993 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (12)..(12): base is a locked nucleic acid
ggarrargaaggraa

SEQ ID NO: 2994 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (2)..(2): base is a locked nucleic acid
garrargarggraaa

SEQ ID NO: 2995 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (2)..(2): base is a locked nucleic acid
ggarrargaaggraa

SEQ ID NO: 2996 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (6)..(6): base is a locked nucleic acid
garrargarggraaa

SEQ ID NO: 2997 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (7)..(7): base is a locked nucleic acid
ggarrargaaggraa

SEQ ID NO: 2998 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (1)..(1): base is a locked nucleic acid
garrargarggraaa

SEQ ID NO: 2999 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (4)..(4): base is a locked nucleic acid
ggarrargaaggraa

SEQ ID NO: 3000 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (7)..(7): base is a locked nucleic acid
garrargarggraaa

SEQ ID NO: 3001 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (6)..(6): base is a locked nucleic acid
ggarrargaaggraa

SEQ ID NO: 3002 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
garrargarggraaa

SEQ ID NO: 3003 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (15)..(15): base is a locked nucleic acid
ggarrargaaggraa

SEQ ID NO: 3004 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (15)..(15): base is a locked nucleic acid
garrargarggraaa

SEQ ID NO: 3005 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (13)..(13): base is a locked nucleic acid
ggarrargaaggraa

SEQ ID NO: 3006 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (12)..(12): base is a locked nucleic acid
garrargarggraaa

SEQ ID NO: 3007 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
ggarrargaaggraa

SEQ ID NO: 3008 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (13)..(13): base is a locked nucleic acid
garrargarggraaa

SEQ ID NO: 3009 - DNA, 16 bp, Artificial Sequence
  Oligonucleotide probe
  misc_binding (1)..(16): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
ggarrargaaggraaa

SEQ ID NO: 3010 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (3)..(3): base is a locked nucleic acid
  modified_base (8)..(8): base is a locked nucleic acid
  modified_base (10)..(10): base is a locked nucleic acid
garrargarggraaa

SEQ ID NO: 3011 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (2)..(2): base is a locked nucleic acid
  modified_base (8)..(8): base is a locked nucleic acid
  modified_base (10)..(10): base is a locked nucleic acid
ggarrargaaggraa

SEQ ID NO: 3012 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (7)..(7): base is a locked nucleic acid
  modified_base (8)..(8): base is a locked nucleic acid
  modified_base (10)..(10): base is a locked nucleic acid
garrargarggraaa

SEQ ID NO: 3013 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (1)..(1): base is a locked nucleic acid
  modified_base (8)..(8): base is a locked nucleic acid
  modified_base (10)..(10): base is a locked nucleic acid
ggarrargaaggraa

SEQ ID NO: 3014 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (2)..(2): base is a locked nucleic acid
  modified_base (8)..(8): base is a locked nucleic acid
  modified_base (10)..(10): base is a locked nucleic acid
garrargarggraaa

SEQ ID NO: 3015 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (5)..(5): base is a locked nucleic acid
  modified_base (8)..(8): base is a locked nucleic acid
  modified_base (10)..(10): base is a locked nucleic acid
ggarrargaaggraa

SEQ ID NO: 3016 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (4)..(4): base is a locked nucleic acid
  modified_base (8)..(8): base is a locked nucleic acid
  modified_base (10)..(10): base is a locked nucleic acid
garrargarggraaa

SEQ ID NO: 3017 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (6)..(6): base is a locked nucleic acid
  modified_base (8)..(8): base is a locked nucleic acid
  modified_base (10)..(10): base is a locked nucleic acid
ggarrargaaggraa

SEQ ID NO: 3018 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
garrargarggraaa

SEQ ID NO: 3019 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
ggarrargaaggraa

SEQ ID NO: 3020 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (13)..(13): base is a locked nucleic acid
garrargarggra

SEQ ID NO: 3021 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
ggarrargaaggr

SEQ ID NO: 3022 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (10)..(10): base is a locked nucleic acid
garrargarggra

SEQ ID NO: 3023 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (10)..(10): base is a locked nucleic acid
ggarrargaaggr

SEQ ID NO: 3024 - DNA, 14 bp, Artificial Sequence
  Oligonucleotide probe
  misc_binding (1)..(14): Hybridization probe for the specific detection of wild-type HIV-1 at codon 44 of the reverse transcriptase gene.
garrargarggraa

SEQ ID NO: 3025 - DNA, 14 bp, Artificial Sequence
  Oligonucleotide probe
  misc_binding (1)..(14): Hybridization probe for the specific detection of wild-type HIV-1 at codon 44 of the reverse transcriptase gene.
ggarrargaaggra

SEQ ID NO: 3026 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
garrargarggra

SEQ ID NO: 3027 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (12)..(12): base is a locked nucleic acid
ggarrargaaggr

SEQ ID NO: 3028 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (2)..(2): base is a locked nucleic acid
garrargarggra

SEQ ID NO: 3029 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (2)..(2): base is a locked nucleic acid
ggarrargaaggr

SEQ ID NO: 3030 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (6)..(6): base is a locked nucleic acid
garrargarggra

SEQ ID NO: 3031 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (7)..(7): base is a locked nucleic acid
ggarrargaaggr

SEQ ID NO: 3032 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (1)..(1): base is a locked nucleic acid
garrargarggra

SEQ ID NO: 3033 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (4)..(4): base is a locked nucleic acid
ggarrargaaggr

SEQ ID NO: 3034 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (7)..(7): base is a locked nucleic acid
garrargarggra

SEQ ID NO: 3035 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (6)..(6): base is a locked nucleic acid
ggarrargaaggr

SEQ ID NO: 3036 - DNA, 14 bp, Artificial Sequence
  Oligonucleotide probe
  misc_binding (1)..(14): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
garrargarggraa

SEQ ID NO: 3037 - DNA, 14 bp, Artificial Sequence
  Oligonucleotide probe
  misc_binding (1)..(14): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
ggarrargaaggra

SEQ ID NO: 3038 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (13)..(13): base is a locked nucleic acid
ggarrargaaggr

SEQ ID NO: 3039 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (12)..(12): base is a locked nucleic acid
garrargarggra

SEQ ID NO: 3040 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
  modified_base (13)..(13): base is a locked nucleic acid
garrargarggra

SEQ ID NO: 3041 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (3)..(3): base is a locked nucleic acid
  modified_base (8)..(8): base is a locked nucleic acid
  modified_base (10)..(10): base is a locked nucleic acid
garrargarggra

SEQ ID NO: 3042 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (2)..(2): base is a locked nucleic acid
  modified_base (8)..(8): base is a locked nucleic acid
  modified_base (10)..(10): base is a locked nucleic acid
ggarrargaaggr

SEQ ID NO: 3043 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (7)..(7): base is a locked nucleic acid
  modified_base (8)..(8): base is a locked nucleic acid
  modified_base (10)..(10): base is a locked nucleic acid
garrargarggra

SEQ ID NO: 3044 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (1)..(1): base is a locked nucleic acid
  modified_base (8)..(8): base is a locked nucleic acid
  modified_base (10)..(10): base is a locked nucleic acid
ggarrargaaggr

SEQ ID NO: 3045 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (2)..(2): base is a locked nucleic acid
  modified_base (8)..(8): base is a locked nucleic acid
  modified_base (10)..(10): base is a locked nucleic acid
garrargarggra

SEQ ID NO: 3046 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (5)..(5): base is a locked nucleic acid
  modified_base (8)..(8): base is a locked nucleic acid
  modified_base (10)..(10): base is a locked nucleic acid
ggarrargaaggr

SEQ ID NO: 3047 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (4)..(4): base is a locked nucleic acid
  modified_base (8)..(8): base is a locked nucleic acid
  modified_base (10)..(10): base is a locked nucleic acid
garrargarggra

SEQ ID NO: 3048 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (6)..(6): base is a locked nucleic acid
  modified_base (8)..(8): base is a locked nucleic acid
  modified_base (10)..(10): base is a locked nucleic acid
ggarrargaaggr

SEQ ID NO: 3049 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
garrargarggra

SEQ ID NO: 3050 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
  modified_base (8)..(8): base is a locked nucleic acid
  modified_base (10)..(10): base is a locked nucleic acid
ggarrargaaggr

SEQ ID NO: 3051 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
aaaaggaaggaaaaa

SEQ ID NO: 3052 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
ggarrargarggraaaaty

SEQ ID NO: 3053 - DNA, 19 bp, Artificial Sequence
  Oligonucleotide probe
  misc_binding (1)..(19): Hybridization probe for the specific detection of wild-type HIV-1 at codon 44 of the reverse transcriptase gene.
tggarrargaaggraaaat

SEQ ID NO: 3054 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
garrargarggraaaat

SEQ ID NO: 3055 - DNA, 17 bp, Artificial Sequence
  Oligonucleotide probe
  misc_binding (1)..(17): Hybridization probe for the specific detection of wild-type HIV-1 at codon 44 of the reverse transcriptase gene.
ggarrargaaggraaaa

SEQ ID NO: 3056 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
garrargarggraaa

SEQ ID NO: 3057 - DNA, 15 bp, Artificial Sequence
  Oligonucleotide probe
  misc_binding (1)..(15): Hybridization probe for the specific detection of wild-type HIV-1 at codon 44 of the reverse transcriptase gene.
ggarrargaaggraa

SEQ ID NO: 3058 - DNA, 16 bp, Artificial Sequence
  Oligonucleotide probe
  misc_binding (1)..(16): Hybridization probe for the specific detection of wild-type HIV-1 at codon 44 of the reverse transcriptase gene.
ggarrargaaggraaa

SEQ ID NO: 3059 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
garrargarggra

SEQ ID NO: 3060 - DNA, 13 bp, Artificial Sequence
  Oligonucleotide probe
  misc_binding (1)..(13): Hybridization probe for the specific detection of wild-type HIV-1 at codon 44 of the reverse transcriptase gene.
ggarrargaaggr

SEQ ID NO: 3061 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (14)..(14): base is a locked nucleic acid
cartatttgcyataaaraa

SEQ ID NO: 3062 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (12)..(12): base is a locked nucleic acid
cartatttgcyataaaraa

SEQ ID NO: 3063 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (18)..(18): base is a locked nucleic acid
cartatttgcyataaaraa

SEQ ID NO: 3064 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (17)..(17): base is a locked nucleic acid
cartatttgcyataaaraa

SEQ ID NO: 3065 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (3)..(3): base is a locked nucleic acid
cartatttgcyataaaraa

SEQ ID NO: 3066 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (7)..(7): base is a locked nucleic acid
cartatttgcyataaaraa

SEQ ID NO: 3067 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (8)..(8): base is a locked nucleic acid
cartatttgcyataaaraa

SEQ ID NO: 3068 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (6)..(6): base is a locked nucleic acid
cartatttgcyataaaraa

SEQ ID NO: 3069 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (9)..(9): base is a locked nucleic acid
  modified_base (11)..(11): base is a locked nucleic acid
  modified_base (15)..(15): base is a locked nucleic acid
cartatttgcyataaaraa

SEQ ID NO: 3070 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (9)..(9): base is a locked nucleic acid
  modified_base (11)..(11): base is a locked nucleic acid
  modified_base (18)..(18): base is a locked nucleic acid
cartatttgcyataaaraa

SEQ ID NO: 3071 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (9)..(9): base is a locked nucleic acid
  modified_base (11)..(11): base is a locked nucleic acid
  modified_base (12)..(12): base is a locked nucleic acid
cartatttgcyataaaraa

SEQ ID NO: 3072 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (9)..(9): base is a locked nucleic acid
  modified_base (11)..(11): base is a locked nucleic acid
  modified_base (16)..(16): base is a locked nucleic acid
cartatttgcyataaaraa

SEQ ID NO: 3073 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (8)..(8): base is a locked nucleic acid
  modified_base (9)..(9): base is a locked nucleic acid
  modified_base (11)..(11): base is a locked nucleic acid
cartatttgcyataaaraa

SEQ ID NO: 3074 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (5)..(5): base is a locked nucleic acid
  modified_base (9)..(9): base is a locked nucleic acid
  modified_base (11)..(11): base is a locked nucleic acid
cartatttgcyataaaraa

SEQ ID NO: 3075 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (7)..(7): base is a locked nucleic acid
  modified_base (9)..(9): base is a locked nucleic acid
  modified_base (11)..(11): base is a locked nucleic acid
cartatttgcyataaaraa

SEQ ID NO: 3076 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (2)..(2): base is a locked nucleic acid
  modified_base (9)..(9): base is a locked nucleic acid
  modified_base (11)..(11): base is a locked nucleic acid
cartatttgcyataaaraa

SEQ ID NO: 3077 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
  modified_base (9)..(9): base is a locked nucleic acid
  modified_base (11)..(11): base is a locked nucleic acid
cartatttgcyataaaraa

SEQ ID NO: 3078 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (13)..(13): base is a locked nucleic acid
artatttgcyataaara

SEQ ID NO: 3079 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (11)..(11): base is a locked nucleic acid
artatttgcyataaara

SEQ ID NO: 3080 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (17)..(17): base is a locked nucleic acid
artatttgcyataaara

SEQ ID NO: 3081 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (16)..(16): base is a locked nucleic acid
artatttgcyataaara

SEQ ID NO: 3082 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (2)..(2): base is a locked nucleic acid
artatttgcyataaara

SEQ ID NO: 3083 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (6)..(6): base is a locked nucleic acid
artatttgcyataaara

SEQ ID NO: 3084 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (7)..(7): base is a locked nucleic acid
artatttgcyataaara

SEQ ID NO: 3085 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (5)..(5): base is a locked nucleic acid
artatttgcyataaara

SEQ ID NO: 3086 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (14)..(14): base is a locked nucleic acid
artatttgcyataaara

SEQ ID NO: 3087 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (17)..(17): base is a locked nucleic acid
artatttgcyataaara

SEQ ID NO: 3088 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (11)..(11): base is a locked nucleic acid
artatttgcyataaara

SEQ ID NO: 3089 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (15)..(15): base is a locked nucleic acid
artatttgcyataaara

SEQ ID NO: 3090 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (7)..(7): base is a locked nucleic acid
  modified_base (8)..(8): base is a locked nucleic acid
  modified_base (10)..(10): base is a locked nucleic acid
artatttgcyataaara

SEQ ID NO: 3091 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (4)..(4): base is a locked nucleic acid
  modified_base (8)..(8): base is a locked nucleic acid
  modified_base (10)..(10): base is a locked nucleic acid
artatttgcyataaara

SEQ ID NO: 3092 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (6)..(6): base is a locked nucleic acid
  modified_base (8)..(8): base is a locked nucleic acid
  modified_base (10)..(10): base is a locked nucleic acid
artatttgcyataaara

SEQ ID NO: 3093 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (1)..(1): base is a locked nucleic acid
  modified_base (8)..(8): base is a locked nucleic acid
  modified_base (10)..(10): base is a locked nucleic acid
artatttgcyataaara

SEQ ID NO: 3094 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
artatttgcyataaara

SEQ ID NO: 3095 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (13)..(13): base is a locked nucleic acid
artatttgcyataaa

SEQ ID NO: 3096 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (11)..(11): base is a locked nucleic acid
artatttgcyataaa

SEQ ID NO: 3097 - DNA, 16 bp, Artificial Sequence
  Oligonucleotide probe
  misc_binding (1)..(16): Hybridization probe for the specific detection of wild-type HIV-1 at codon 62 of the reverse transcriptase gene.
artatttgcyataaar

SEQ ID NO: 3098 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
artatttgcyataaa

SEQ ID NO: 3099 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (2)..(2): base is a locked nucleic acid
artatttgcyataaa

SEQ ID NO: 3100 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (6)..(6): base is a locked nucleic acid
artatttgcyataaa

SEQ ID NO: 3101 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (7)..(7): base is a locked nucleic acid
artatttgcyataaa

SEQ ID NO: 3102 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (5)..(5): base is a locked nucleic acid
artatttgcyataaa

SEQ ID NO: 3103 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (14)..(14): base is a locked nucleic acid
artatttgcyataaa

SEQ ID NO: 3104 - DNA, 16 bp, Artificial Sequence
  Oligonucleotide probe
  misc_binding (1)..(16): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
artatttgcyataaar

SEQ ID NO: 3105 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (11)..(11): base is a locked nucleic acid
artatttgcyataaa

SEQ ID NO: 3106 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (15)..(15): base is a locked nucleic acid
artatttgcyataaa

SEQ ID NO: 3107 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (7)..(7): base is a locked nucleic acid
  modified_base (8)..(8): base is a locked nucleic acid
  modified_base (10)..(10): base is a locked nucleic acid
artatttgcyataaa

SEQ ID NO: 3108 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (4)..(4): base is a locked nucleic acid
  modified_base (8)..(8): base is a locked nucleic acid
  modified_base (10)..(10): base is a locked nucleic acid
artatttgcyataaa

SEQ ID NO: 3109 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (6)..(6): base is a locked nucleic acid
  modified_base (8)..(8): base is a locked nucleic acid
  modified_base (10)..(10): base is a locked nucleic acid
artatttgcyataaa

SEQ ID NO: 3110 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (1)..(1): base is a locked nucleic acid
  modified_base (8)..(8): base is a locked nucleic acid
  modified_base (10)..(10): base is a locked nucleic acid
artatttgcyataaa

SEQ ID NO: 3111 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
artatttgcyataaa

SEQ ID NO: 3112 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (13)..(13): base is a locked nucleic acid
artatttgcyata

SEQ ID NO: 3113 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (11)..(11): base is a locked nucleic acid
artatttgcyata

SEQ ID NO: 3114 - DNA, 14 bp, Artificial Sequence
  Oligonucleotide probe
  misc_binding (1)..(14): Hybridization probe for the specific detection of wild-type HIV-1 at codon 62 of the reverse transcriptase gene.
artatttgcyataa

SEQ ID NO: 3115 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (2)..(2): base is a locked nucleic acid
artatttgcyata

SEQ ID NO: 3116 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (6)..(6): base is a locked nucleic acid
artatttgcyata

SEQ ID NO: 3117 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (7)..(7): base is a locked nucleic acid
artatttgcyata

SEQ ID NO: 3118 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (5)..(5): base is a locked nucleic acid
artatttgcyata

SEQ ID NO: 3119 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
artatttgcyata

SEQ ID NO: 3120 - DNA, 14 bp, Artificial Sequence
  Oligonucleotide probe
  misc_binding (1)..(14): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
artatttgcyataa

SEQ ID NO: 3121 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
  modified_base (11)..(11): base is a locked nucleic acid
artatttgcyata

SEQ ID NO: 3122 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (7)..(7): base is a locked nucleic acid
  modified_base (8)..(8): base is a locked nucleic acid
  modified_base (10)..(10): base is a locked nucleic acid
artatttgcyata

SEQ ID NO: 3123 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (4)..(4): base is a locked nucleic acid
  modified_base (8)..(8): base is a locked nucleic acid
  modified_base (10)..(10): base is a locked nucleic acid
artatttgcyata

SEQ ID NO: 3124 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (6)..(6): base is a locked nucleic acid
  modified_base (8)..(8): base is a locked nucleic acid
  modified_base (10)..(10): base is a locked nucleic acid
artatttgcyata

SEQ ID NO: 3125 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (1)..(1): base is a locked nucleic acid
  modified_base (8)..(8): base is a locked nucleic acid
  modified_base (10)..(10): base is a locked nucleic acid
artatttgcyata

SEQ ID NO: 3126 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
  modified_base (8)..(8): base is a locked nucleic acid
  modified_base (10)..(10): base is a locked nucleic acid
artatttgcyata

SEQ ID NO: 3127 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
ctttatdgcaaatac

SEQ ID NO: 3128 - DNA, 19 bp, Artificial Sequence
  Oligonucleotide probe
  misc_binding (1)..(19): Hybridization probe for the specific detection of wild-type HIV-1 at codon 62 of the reverse transcriptase gene.
cartatttgcyataaaraa

SEQ ID NO: 3129 - DNA, 17 bp, Artificial Sequence
  Oligonucleotide probe
  misc_binding (1)..(17): Hybridization probe for the specific detection of wild-type HIV-1 at codon 62 of the reverse transcriptase gene.
artatttgcyataaara

SEQ ID NO: 3130 - DNA, 15 bp, Artificial Sequence
  Oligonucleotide probe
  misc_binding (1)..(15): Hybridization probe for the specific detection of wild-type HIV-1 at codon 62 of the reverse transcriptase gene.
artatttgcyataaa

SEQ ID NO: 3131 - DNA, 13 bp, Artificial Sequence
  Oligonucleotide probe
  misc_binding (1)..(13): Hybridization probe for the specific detection of wild-type HIV-1 at codon 62 of the reverse transcriptase gene.
artatttgcyata

SEQ ID NO: 3132 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (19)..(19): base is a locked nucleic acid
cyataaaraaraargayag

SEQ ID NO: 3133 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (14)..(14): base is a locked nucleic acid
yataaaraaraargayagy

SEQ ID NO: 3134 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (17)..(17): base is a locked nucleic acid
cyataaaraaraargayag

SEQ ID NO: 3135 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (11)..(11): base is a locked nucleic acid
yataaaraaraargayagy

SEQ ID NO: 3136 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (18)..(18): base is a locked nucleic acid
cyataaaraaraargayag

SEQ ID NO: 3137 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (17)..(17): base is a locked nucleic acid
yataaaraaraargayagy

SEQ ID NO: 3138 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (13)..(13): base is a locked nucleic acid
cyataaaraaraargayag

SEQ ID NO: 3139 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (15)..(15): base is a locked nucleic acid
yataaaraaraargayagy

SEQ ID NO: 3140 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (7)..(7): base is a locked nucleic acid
cyataaaraaraargayag

SEQ ID NO: 3141 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (3)..(3): base is a locked nucleic acid
yataaaraaraargayagy

SEQ ID NO: 3142 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (3)..(3): base is a locked nucleic acid
cyataaaraaraargayag

SEQ ID NO: 3143 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (7)..(7): base is a locked nucleic acid
yataaaraaraargayagy

SEQ ID NO: 3144 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (2)..(2): base is a locked nucleic acid
cyataaaraaraargayag

SEQ ID NO: 3145 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (2)..(2): base is a locked nucleic acid
yataaaraaraargayagy

SEQ ID NO: 3146 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (4)..(4): base is a locked nucleic acid
cyataaaraaraargayag

SEQ ID NO: 3147 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (8)..(8): base is a locked nucleic acid
yataaaraaraargayagy

SEQ ID NO: 3148 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (13)..(13): base is a locked nucleic acid
cyataaaraaraargayag

SEQ ID NO: 3149 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (17)..(17): base is a locked nucleic acid
yataaaraaraargayagy

SEQ ID NO: 3150 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (16)..(16): base is a locked nucleic acid
cyataaaraaraargayag

SEQ ID NO: 3151 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (16)..(16): base is a locked nucleic acid
yataaaraaraargayagy

SEQ ID NO: 3152 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (14)..(14): base is a locked nucleic acid
cyataaaraaraargayag

SEQ ID NO: 3153 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (13)..(13): base is a locked nucleic acid
yataaaraaraargayagy

SEQ ID NO: 3154 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (15)..(15): base is a locked nucleic acid
cyataaaraaraargayag

SEQ ID NO: 3155 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
  modified_base (14)..(14): base is a locked nucleic acid
yataaaraaraargayagy

SEQ ID NO: 3156 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (4)..(4): base is a locked nucleic acid
  modified_base (9)..(9): base is a locked nucleic acid
  modified_base (11)..(11): base is a locked nucleic acid
cyataaaraaraargayag

SEQ ID NO: 3157 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (4)..(4): base is a locked nucleic acid
  modified_base (9)..(9): base is a locked nucleic acid
  modified_base (11)..(11): base is a locked nucleic acid
yataaaraaraargayagy

SEQ ID NO: 3158 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (7)..(7): base is a locked nucleic acid
  modified_base (9)..(9): base is a locked nucleic acid
  modified_base (11)..(11): base is a locked nucleic acid
cyataaaraaraargayag

SEQ ID NO: 3159 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (8)..(8): base is a locked nucleic acid
  modified_base (9)..(9): base is a locked nucleic acid
  modified_base (11)..(11): base is a locked nucleic acid
yataaaraaraargayagy

SEQ ID NO: 3160 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (2)..(2): base is a locked nucleic acid
  modified_base (9)..(9): base is a locked nucleic acid
  modified_base (11)..(11): base is a locked nucleic acid
cyataaaraaraargayag

SEQ ID NO: 3161 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (3)..(3): base is a locked nucleic acid
  modified_base (9)..(9): base is a locked nucleic acid
  modified_base (11)..(11): base is a locked nucleic acid
yataaaraaraargayagy

SEQ ID NO: 3162 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (3)..(3): base is a locked nucleic acid
  modified_base (9)..(9): base is a locked nucleic acid
  modified_base (11)..(11): base is a locked nucleic acid
cyataaaraaraargayag

SEQ ID NO: 3163 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (5)..(5): base is a locked nucleic acid
  modified_base (9)..(9): base is a locked nucleic acid
  modified_base (11)..(11): base is a locked nucleic acid
yataaaraaraargayagy

SEQ ID NO: 3164 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
cyataaaraaraargayag

SEQ ID NO: 3165 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
  modified_base (9)..(9): base is a locked nucleic acid
  modified_base (11)..(11): base is a locked nucleic acid
yataaaraaraargayagy

SEQ ID NO: 3166 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
yataaaraaraargaya

SEQ ID NO: 3167 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (13)..(13): base is a locked nucleic acid
ataaaraaraargayag

SEQ ID NO: 3168 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (16)..(16): base is a locked nucleic acid
yataaaraaraargaya

SEQ ID NO: 3169 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (10)..(10): base is a locked nucleic acid
ataaaraaraargayag

SEQ ID NO: 3170 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (17)..(17): base is a locked nucleic acid
yataaaraaraargaya

SEQ ID NO: 3171 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (16)..(16): base is a locked nucleic acid
ataaaraaraargayag

SEQ ID NO: 3172 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (12)..(12): base is a locked nucleic acid
yataaaraaraargaya

SEQ ID NO: 3173 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (14)..(14): base is a locked nucleic acid
ataaaraaraargayag

SEQ ID NO: 3174 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (6)..(6): base is a locked nucleic acid
yataaaraaraargaya

SEQ ID NO: 3175 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (2)..(2): base is a locked nucleic acid
ataaaraaraargayag

SEQ ID NO: 3176 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (2)..(2): base is a locked nucleic acid
yataaaraaraargaya

SEQ ID NO: 3177 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (6)..(6): base is a locked nucleic acid
ataaaraaraargayag

SEQ ID NO: 3178 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (1)..(1): base is a locked nucleic acid
yataaaraaraargaya

SEQ ID NO: 3179 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (1)..(1): base is a locked nucleic acid
ataaaraaraargayag

SEQ ID NO: 3180 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (3)..(3): base is a locked nucleic acid
yataaaraaraargaya

SEQ ID NO: 3181 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (7)..(7): base is a locked nucleic acid
ataaaraaraargayag

SEQ ID NO: 3182 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (12)..(12): base is a locked nucleic acid
yataaaraaraargaya

SEQ ID NO: 3183 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (16)..(16): base is a locked nucleic acid
ataaaraaraargayag

SEQ ID NO: 3184 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (15)..(15): base is a locked nucleic acid
yataaaraaraargaya

SEQ ID NO: 3185 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (15)..(15): base is a locked nucleic acid
ataaaraaraargayag

SEQ ID NO: 3186 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (13)..(13): base is a locked nucleic acid
yataaaraaraargaya

SEQ ID NO: 3187 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (12)..(12): base is a locked nucleic acid
ataaaraaraargayag

SEQ ID NO: 3188 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (14)..(14): base is a locked nucleic acid
yataaaraaraargaya

SEQ ID NO: 3189 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (13)..(13): base is a locked nucleic acid
ataaaraaraargayag

SEQ ID NO: 3190 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (3)..(3): base is a locked nucleic acid
  modified_base (8)..(8): base is a locked nucleic acid
  modified_base (10)..(10): base is a locked nucleic acid
yataaaraaraargaya

SEQ ID NO: 3191 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (3)..(3): base is a locked nucleic acid
  modified_base (8)..(8): base is a locked nucleic acid
  modified_base (10)..(10): base is a locked nucleic acid
ataaaraaraargayag

SEQ ID NO: 3192 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (6)..(6): base is a locked nucleic acid
  modified_base (8)..(8): base is a locked nucleic acid
  modified_base (10)..(10): base is a locked nucleic acid
yataaaraaraargaya

SEQ ID NO: 3193 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (7)..(7): base is a locked nucleic acid
  modified_base (8)..(8): base is a locked nucleic acid
  modified_base (10)..(10): base is a locked nucleic acid
ataaaraaraargayag

SEQ ID NO: 3194 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (1)..(1): base is a locked nucleic acid
  modified_base (8)..(8): base is a locked nucleic acid
  modified_base (10)..(10): base is a locked nucleic acid
yataaaraaraargaya

SEQ ID NO: 3195 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (2)..(2): base is a locked nucleic acid
  modified_base (8)..(8): base is a locked nucleic acid
  modified_base (10)..(10): base is a locked nucleic acid
ataaaraaraargayag

SEQ ID NO: 3196 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (2)..(2): base is a locked nucleic acid
  modified_base (8)..(8): base is a locked nucleic acid
  modified_base (10)..(10): base is a locked nucleic acid
yataaaraaraargaya

SEQ ID NO: 3197 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (4)..(4): base is a locked nucleic acid
  modified_base (8)..(8): base is a locked nucleic acid
  modified_base (10)..(10): base is a locked nucleic acid
ataaaraaraargayag

SEQ ID NO: 3198 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
yataaaraaraargaya

SEQ ID NO: 3199 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
ataaaraaraargayag

SEQ ID NO: 3200 - DNA, 16 bp, Artificial Sequence
  Oligonucleotide probe
  misc_binding (1)..(16): Hybridization probe for the specific detection of wild-type HIV-1 at codon 65 of the reverse transcriptase gene.
yataaaraaraargay

SEQ ID NO: 3201 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (13)..(13): base is a locked nucleic acid
ataaaraaraargay

SEQ ID NO: 3202 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
yataaaraaraarga

SEQ ID NO: 3203 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (10)..(10): base is a locked nucleic acid
ataaaraaraargay

SEQ ID NO: 3204 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
ataaaraaraargay

SEQ ID NO: 3205 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (12)..(12): base is a locked nucleic acid
yataaaraaraarga

SEQ ID NO: 3206 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (14)..(14): base is a locked nucleic acid
ataaaraaraargay

SEQ ID NO: 3207 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (6)..(6): base is a locked nucleic acid
yataaaraaraarga

SEQ ID NO: 3208 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (2)..(2): base is a locked nucleic acid
ataaaraaraargay

SEQ ID NO: 3209 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (2)..(2): base is a locked nucleic acid
yataaaraaraarga

SEQ ID NO: 3210 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (6)..(6): base is a locked nucleic acid
ataaaraaraargay

SEQ ID NO: 3211 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (1)..(1): base is a locked nucleic acid
yataaaraaraarga

SEQ ID NO: 3212 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (1)..(1): base is a locked nucleic acid
ataaaraaraargay

SEQ ID NO: 3213 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (3)..(3): base is a locked nucleic acid
yataaaraaraarga

SEQ ID NO: 3214 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (7)..(7): base is a locked nucleic acid
ataaaraaraargay

SEQ ID NO: 3215 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (12)..(12): base is a locked nucleic acid
yataaaraaraarga

SEQ ID NO: 3216 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
ataaaraaraargay

SEQ ID NO: 3217 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (15)..(15): base is a locked nucleic acid
yataaaraaraarga

SEQ ID NO: 3218 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (15)..(15): base is a locked nucleic acid
ataaaraaraargay

SEQ ID NO: 3219 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (13)..(13): base is a locked nucleic acid
yataaaraaraarga

SEQ ID NO: 3220 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (12)..(12): base is a locked nucleic acid
ataaaraaraargay

SEQ ID NO: 3221 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (14)..(14): base is a locked nucleic acid
yataaaraaraarga

SEQ ID NO: 3222 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (13)..(13): base is a locked nucleic acid
ataaaraaraargay

SEQ ID NO: 3223 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (3)..(3): base is a locked nucleic acid
  modified_base (8)..(8): base is a locked nucleic acid
  modified_base (10)..(10): base is a locked nucleic acid
yataaaraaraarga

SEQ ID NO: 3224 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (3)..(3): base is a locked nucleic acid
  modified_base (8)..(8): base is a locked nucleic acid
  modified_base (10)..(10): base is a locked nucleic acid
ataaaraaraargay

SEQ ID NO: 3225 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (6)..(6): base is a locked nucleic acid
  modified_base (8)..(8): base is a locked nucleic acid
  modified_base (10)..(10): base is a locked nucleic acid
yataaaraaraarga

SEQ ID NO: 3226 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (7)..(7): base is a locked nucleic acid
  modified_base (8)..(8): base is a locked nucleic acid
  modified_base (10)..(10): base is a locked nucleic acid
ataaaraaraargay

SEQ ID NO: 3227 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (1)..(1): base is a locked nucleic acid
  modified_base (8)..(8): base is a locked nucleic acid
  modified_base (10)..(10): base is a locked nucleic acid
yataaaraaraarga

SEQ ID NO: 3228 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (2)..(2): base is a locked nucleic acid
  modified_base (8)..(8): base is a locked nucleic acid
  modified_base (10)..(10): base is a locked nucleic acid
ataaaraaraargay

SEQ ID NO: 3229 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (2)..(2): base is a locked nucleic acid
  modified_base (8)..(8): base is a locked nucleic acid
  modified_base (10)..(10): base is a locked nucleic acid
yataaaraaraarga

SEQ ID NO: 3230 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (4)..(4): base is a locked nucleic acid
  modified_base (8)..(8): base is a locked nucleic acid
  modified_base (10)..(10): base is a locked nucleic acid
ataaaraaraargay

SEQ ID NO: 3231 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
yataaaraaraarga

SEQ ID NO: 3232 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
ataaaraaraargay

SEQ ID NO: 3233 - DNA, 14 bp, Artificial Sequence
  Oligonucleotide probe
  misc_binding (1)..(14): Hybridization probe for the specific detection of wild-type HIV-1 at codon 65 of the reverse transcriptase gene.
yataaaraaraarg

SEQ ID NO: 3234 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (13)..(13): base is a locked nucleic acid
ataaaraaraarg

SEQ ID NO: 3235 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (10)..(10): base is a locked nucleic acid
ataaaraaraarg

SEQ ID NO: 3236 - DNA, 14 bp, Artificial Sequence
  Oligonucleotide probe
  misc_binding (1)..(14): Hybridization probe for the specific detection of wild-type HIV-1 at codon 65 of the reverse transcriptase gene.
ataaaraaraarga

SEQ ID NO: 3237 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (12)..(12): base is a locked nucleic acid
yataaaraaraar

SEQ ID NO: 3238 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
ataaaraaraarg

SEQ ID NO: 3239 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (6)..(6): base is a locked nucleic acid
yataaaraaraar

SEQ ID NO: 3240 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (2)..(2): base is a locked nucleic acid
ataaaraaraarg

SEQ ID NO: 3241 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (2)..(2): base is a locked nucleic acid
yataaaraaraar

SEQ ID NO: 3242 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (6)..(6): base is a locked nucleic acid
ataaaraaraarg

SEQ ID NO: 3243 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (1)..(1): base is a locked nucleic acid
yataaaraaraar

SEQ ID NO: 3244 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (1)..(1): base is a locked nucleic acid
ataaaraaraarg

SEQ ID NO: 3245 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (3)..(3): base is a locked nucleic acid
yataaaraaraar

SEQ ID NO: 3246 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (7)..(7): base is a locked nucleic acid
ataaaraaraarg

SEQ ID NO: 3247 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (12)..(12): base is a locked nucleic acid
yataaaraaraar

SEQ ID NO: 3248 - DNA, 14 bp, Artificial Sequence
  Oligonucleotide probe
  misc_binding (1)..(14): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
ataaaraaraarga

SEQ ID NO: 3249 - DNA, 14 bp, Artificial Sequence
  Oligonucleotide probe
  misc_binding (1)..(14): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
yataaaraaraarg

SEQ ID NO: 3250 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (13)..(13): base is a locked nucleic acid
yataaaraaraar

SEQ ID NO: 3251 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (12)..(12): base is a locked nucleic acid
ataaaraaraarg

SEQ ID NO: 3252 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
yataaaraaraar

SEQ ID NO: 3253 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
  modified_base (13)..(13): base is a locked nucleic acid
ataaaraaraarg

SEQ ID NO: 3254 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (3)..(3): base is a locked nucleic acid
  modified_base (8)..(8): base is a locked nucleic acid
  modified_base (10)..(10): base is a locked nucleic acid
yataaaraaraar

SEQ ID NO: 3255 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (3)..(3): base is a locked nucleic acid
  modified_base (8)..(8): base is a locked nucleic acid
  modified_base (10)..(10): base is a locked nucleic acid
ataaaraaraarg

SEQ ID NO: 3256 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (6)..(6): base is a locked nucleic acid
  modified_base (8)..(8): base is a locked nucleic acid
  modified_base (10)..(10): base is a locked nucleic acid
yataaaraaraar

SEQ ID NO: 3257 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (7)..(7): base is a locked nucleic acid
  modified_base (8)..(8): base is a locked nucleic acid
  modified_base (10)..(10): base is a locked nucleic acid
ataaaraaraarg

SEQ ID NO: 3258 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (1)..(1): base is a locked nucleic acid
  modified_base (8)..(8): base is a locked nucleic acid
  modified_base (10)..(10): base is a locked nucleic acid
yataaaraaraar

SEQ ID NO: 3259 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (2)..(2): base is a locked nucleic acid
  modified_base (8)..(8): base is a locked nucleic acid
  modified_base (10)..(10): base is a locked nucleic acid
ataaaraaraarg

SEQ ID NO: 3260 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (2)..(2): base is a locked nucleic acid
  modified_base (8)..(8): base is a locked nucleic acid
  modified_base (10)..(10): base is a locked nucleic acid
yataaaraaraar

SEQ ID NO: 3261 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (4)..(4): base is a locked nucleic acid
  modified_base (8)..(8): base is a locked nucleic acid
  modified_base (10)..(10): base is a locked nucleic acid
ataaaraaraarg

SEQ ID NO: 3262 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
yataaaraaraar

SEQ ID NO: 3263 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
  modified_base (8)..(8): base is a locked nucleic acid
  modified_base (10)..(10): base is a locked nucleic acid
ataaaraaraarg

SEQ ID NO: 3264 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
ataaagaaraaagac

SEQ ID NO: 3265 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
cyataaaraaraargayag

SEQ ID NO: 3266 - DNA, 19 bp, Artificial Sequence
  Oligonucleotide probe
  misc_binding (1)..(19): Hybridization probe for the specific detection of wild-type HIV-1 at codon 65 of the reverse transcriptase gene.
yataaaraaraargayagy

SEQ ID NO: 3267 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
yataaaraaraargaya

SEQ ID NO: 3268 - DNA, 17 bp, Artificial Sequence
  Oligonucleotide probe
  misc_binding (1)..(17): Hybridization probe for the specific detection of wild-type HIV-1 at codon 65 of the reverse transcriptase gene.
ataaaraaraargayag

SEQ ID NO: 3269 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
ataaaraaraargay

SEQ ID NO: 3270 - DNA, 15 bp, Artificial Sequence
  Oligonucleotide probe
  misc_binding (1)..(15): Hybridization probe for the specific detection of wild-type HIV-1 at codon 65 of the reverse transcriptase gene.
yataaaraaraarga

SEQ ID NO: 3271 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
ataaaraaraarg

SEQ ID NO: 3272 - DNA, 13 bp, Artificial Sequence
  Oligonucleotide probe
  misc_binding (1)..(13): Hybridization probe for the specific detection of wild-type HIV-1 at codon 65 of the reverse transcriptase gene.
yataaaraaraar

SEQ ID NO: 3273 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (12)..(12): base is a locked nucleic acid
aaraaraargayagyacya

SEQ ID NO: 3274 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (14)..(14): base is a locked nucleic acid
araaraargayagyacyaa

SEQ ID NO: 3275 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (19)..(19): base is a locked nucleic acid
raaraargayagyacyaar

SEQ ID NO: 3276 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (17)..(17): base is a locked nucleic acid
aaraaraargayagyacya

SEQ ID NO: 3277 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (12)..(12): base is a locked nucleic acid
araaraargayagyacyaa

SEQ ID NO: 3278 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (17)..(17): base is a locked nucleic acid
raaraargayagyacyaar

SEQ ID NO: 3279 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (14)..(14): base is a locked nucleic acid
aaraaraargayagyacya

SEQ ID NO: 3280 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (18)..(18): base is a locked nucleic acid
araaraargayagyacyaa

SEQ ID NO: 3281 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (18)..(18): base is a locked nucleic acid
raaraargayagyacyaar

SEQ ID NO: 3282 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (11)..(11): base is a locked nucleic acid
aaraaraargayagyacya

SEQ ID NO: 3283 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (17)..(17): base is a locked nucleic acid
araaraargayagyacyaa

SEQ ID NO: 3284 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (13)..(13): base is a locked nucleic acid
raaraargayagyacyaar

SEQ ID NO: 3285 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (4)..(4): base is a locked nucleic acid
aaraaraargayagyacya

SEQ ID NO: 3286 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (3)..(3): base is a locked nucleic acid
araaraargayagyacyaa

SEQ ID NO: 3287 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (7)..(7): base is a locked nucleic acid
raaraargayagyacyaar

SEQ ID NO: 3288 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (8)..(8): base is a locked nucleic acid
aaraaraargayagyacya

SEQ ID NO: 3289 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (7)..(7): base is a locked nucleic acid
araaraargayagyacyaa

SEQ ID NO: 3290 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (3)..(3): base is a locked nucleic acid
raaraargayagyacyaar

SEQ ID NO: 3291 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (3)..(3): base is a locked nucleic acid
aaraaraargayagyacya

SEQ ID NO: 3292 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (8)..(8): base is a locked nucleic acid
araaraargayagyacyaa

SEQ ID NO: 3293 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (2)..(2): base is a locked nucleic acid
raaraargayagyacyaar

SEQ ID NO: 3294 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (7)..(7): base is a locked nucleic acid
aaraaraargayagyacya

SEQ ID NO: 3295 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (6)..(6): base is a locked nucleic acid
araaraargayagyacyaa

SEQ ID NO: 3296 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (4)..(4): base is a locked nucleic acid
raaraargayagyacyaar

SEQ ID NO: 3297 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (12)..(12): base is a locked nucleic acid
aaraaraargayagyacya

SEQ ID NO: 3298 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (15)..(15): base is a locked nucleic acid
araaraargayagyacyaa

SEQ ID NO: 3299 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (13)..(13): base is a locked nucleic acid
raaraargayagyacyaar

SEQ ID NO: 3300 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (14)..(14): base is a locked nucleic acid
aaraaraargayagyacya

SEQ ID NO: 3301 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (18)..(18): base is a locked nucleic acid
araaraargayagyacyaa

SEQ ID NO: 3302 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (16)..(16): base is a locked nucleic acid
raaraargayagyacyaar

SEQ ID NO: 3303 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (16)..(16): base is a locked nucleic acid
aaraaraargayagyacya

SEQ ID NO: 3304 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (12)..(12): base is a locked nucleic acid
araaraargayagyacyaa

SEQ ID NO: 3305 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (14)..(14): base is a locked nucleic acid
raaraargayagyacyaar

SEQ ID NO: 3306 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (17)..(17): base is a locked nucleic acid
aaraaraargayagyacya

SEQ ID NO: 3307 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (16)..(16): base is a locked nucleic acid
araaraargayagyacyaa

SEQ ID NO: 3308 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
  modified_base (15)..(15): base is a locked nucleic acid
raaraargayagyacyaar

SEQ ID NO: 3309 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (5)..(5): base is a locked nucleic acid
  modified_base (9)..(9): base is a locked nucleic acid
  modified_base (11)..(11): base is a locked nucleic acid
aaraaraargayagyacya

SEQ ID NO: 3310 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (8)..(8): base is a locked nucleic acid
  modified_base (9)..(9): base is a locked nucleic acid
  modified_base (11)..(11): base is a locked nucleic acid
araaraargayagyacyaa

SEQ ID NO: 3311 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (4)..(4): base is a locked nucleic acid
  modified_base (9)..(9): base is a locked nucleic acid
  modified_base (11)..(11): base is a locked nucleic acid
raaraargayagyacyaar

SEQ ID NO: 3312 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (3)..(3): base is a locked nucleic acid
  modified_base (9)..(9): base is a locked nucleic acid
  modified_base (11)..(11): base is a locked nucleic acid
aaraaraargayagyacya

SEQ ID NO: 3313 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (5)..(5): base is a locked nucleic acid
  modified_base (9)..(9): base is a locked nucleic acid
  modified_base (11)..(11): base is a locked nucleic acid
araaraargayagyacyaa

SEQ ID NO: 3314 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (7)..(7): base is a locked nucleic acid
  modified_base (9)..(9): base is a locked nucleic acid
  modified_base (11)..(11): base is a locked nucleic acid
raaraargayagyacyaar

SEQ ID NO: 3315 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (4)..(4): base is a locked nucleic acid
  modified_base (9)..(9): base is a locked nucleic acid
  modified_base (11)..(11): base is a locked nucleic acid
aaraaraargayagyacya

SEQ ID NO: 3316 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (7)..(7): base is a locked nucleic acid
  modified_base (9)..(9): base is a locked nucleic acid
  modified_base (11)..(11): base is a locked nucleic acid
araaraargayagyacyaa

SEQ ID NO: 3317 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (2)..(2): base is a locked nucleic acid
  modified_base (9)..(9): base is a locked nucleic acid
  modified_base (11)..(11): base is a locked nucleic acid
raaraargayagyacyaar

SEQ ID NO: 3318 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (7)..(7): base is a locked nucleic acid
  modified_base (9)..(9): base is a locked nucleic acid
  modified_base (11)..(11): base is a locked nucleic acid
aaraaraargayagyacya

SEQ ID NO: 3319 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (2)..(2): base is a locked nucleic acid
  modified_base (9)..(9): base is a locked nucleic acid
  modified_base (11)..(11): base is a locked nucleic acid
araaraargayagyacyaa

SEQ ID NO: 3320 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (3)..(3): base is a locked nucleic acid
  modified_base (9)..(9): base is a locked nucleic acid
  modified_base (11)..(11): base is a locked nucleic acid
raaraargayagyacyaar

SEQ ID NO: 3321 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
aaraaraargayagyacya

SEQ ID NO: 3322 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
araaraargayagyacyaa

SEQ ID NO: 3323 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
  modified_base (9)..(9): base is a locked nucleic acid
  modified_base (11)..(11): base is a locked nucleic acid
raaraargayagyacyaar

SEQ ID NO: 3324 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (11)..(11): base is a locked nucleic acid
araaraargayagyacy

SEQ ID NO: 3325 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (13)..(13): base is a locked nucleic acid
raaraargayagyacya

SEQ ID NO: 3326 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
aaraargayagyacyaa

SEQ ID NO: 3327 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (16)..(16): base is a locked nucleic acid
araaraargayagyacy

SEQ ID NO: 3328 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (11)..(11): base is a locked nucleic acid
raaraargayagyacya

SEQ ID NO: 3329 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (16)..(16): base is a locked nucleic acid
aaraargayagyacyaa

SEQ ID NO: 3330 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (13)..(13): base is a locked nucleic acid
araaraargayagyacy

SEQ ID NO: 3331 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (17)..(17): base is a locked nucleic acid
raaraargayagyacya

SEQ ID NO: 3332 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (17)..(17): base is a locked nucleic acid
aaraargayagyacyaa

SEQ ID NO: 3333 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (10)..(10): base is a locked nucleic acid
araaraargayagyacy

SEQ ID NO: 3334 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (16)..(16): base is a locked nucleic acid
raaraargayagyacya

SEQ ID NO: 3335 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (12)..(12): base is a locked nucleic acid
aaraargayagyacyaa

SEQ ID NO: 3336 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (3)..(3): base is a locked nucleic acid
araaraargayagyacy

SEQ ID NO: 3337 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (2)..(2): base is a locked nucleic acid
raaraargayagyacya

SEQ ID NO: 3338 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (6)..(6): base is a locked nucleic acid
aaraargayagyacyaa

SEQ ID NO: 3339 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (7)..(7): base is a locked nucleic acid
araaraargayagyacy

SEQ ID NO: 3340 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (6)..(6): base is a locked nucleic acid
raaraargayagyacya

SEQ ID NO: 3341 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (2)..(2): base is a locked nucleic acid
aaraargayagyacyaa

SEQ ID NO: 3342 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (2)..(2): base is a locked nucleic acid
araaraargayagyacy

SEQ ID NO: 3343 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (7)..(7): base is a locked nucleic acid
raaraargayagyacya

SEQ ID NO: 3344 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (1)..(1): base is a locked nucleic acid
aaraargayagyacyaa

SEQ ID NO: 3345 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (6)..(6): base is a locked nucleic acid
araaraargayagyacy

SEQ ID NO: 3346 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (5)..(5): base is a locked nucleic acid
raaraargayagyacya

SEQ ID NO: 3347 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (3)..(3): base is a locked nucleic acid
aaraargayagyacyaa

SEQ ID NO: 3348 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (11)..(11): base is a locked nucleic acid
araaraargayagyacy

SEQ ID NO: 3349 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (14)..(14): base is a locked nucleic acid
raaraargayagyacya

SEQ ID NO: 3350 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (12)..(12): base is a locked nucleic acid
aaraargayagyacyaa

SEQ ID NO: 3351 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (13)..(13): base is a locked nucleic acid
araaraargayagyacy

SEQ ID NO: 3352 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (17)..(17): base is a locked nucleic acid
raaraargayagyacya

SEQ ID NO: 3353 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (15)..(15): base is a locked nucleic acid
aaraargayagyacyaa

SEQ ID NO: 3354 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (15)..(15): base is a locked nucleic acid
araaraargayagyacy

SEQ ID NO: 3355 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (11)..(11): base is a locked nucleic acid
raaraargayagyacya

SEQ ID NO: 3356 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (13)..(13): base is a locked nucleic acid
aaraargayagyacyaa

SEQ ID NO: 3357 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (16)..(16): base is a locked nucleic acid
araaraargayagyacy

SEQ ID NO: 3358 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (15)..(15): base is a locked nucleic acid
raaraargayagyacya

SEQ ID NO: 3359 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (14)..(14): base is a locked nucleic acid
aaraargayagyacyaa

SEQ ID NO: 3360 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (4)..(4): base is a locked nucleic acid
  modified_base (8)..(8): base is a locked nucleic acid
  modified_base (10)..(10): base is a locked nucleic acid
araaraargayagyacy

SEQ ID NO: 3361 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (7)..(7): base is a locked nucleic acid
  modified_base (8)..(8): base is a locked nucleic acid
  modified_base (10)..(10): base is a locked nucleic acid
raaraargayagyacya

SEQ ID NO: 3362 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (3)..(3): base is a locked nucleic acid
  modified_base (8)..(8): base is a locked nucleic acid
  modified_base (10)..(10): base is a locked nucleic acid
aaraargayagyacyaa

SEQ ID NO: 3363 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (2)..(2): base is a locked nucleic acid
  modified_base (8)..(8): base is a locked nucleic acid
  modified_base (10)..(10): base is a locked nucleic acid
araaraargayagyacy

SEQ ID NO: 3364 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (4)..(4): base is a locked nucleic acid
  modified_base (8)..(8): base is a locked nucleic acid
  modified_base (10)..(10): base is a locked nucleic acid
raaraargayagyacya

SEQ ID NO: 3365 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
aaraargayagyacyaa

SEQ ID NO: 3366 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (3)..(3): base is a locked nucleic acid
  modified_base (8)..(8): base is a locked nucleic acid
  modified_base (10)..(10): base is a locked nucleic acid
araaraargayagyacy

SEQ ID NO: 3367 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
raaraargayagyacya

SEQ ID NO: 3368 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (1)..(1): base is a locked nucleic acid
  modified_base (8)..(8): base is a locked nucleic acid
  modified_base (10)..(10): base is a locked nucleic acid
aaraargayagyacyaa

SEQ ID NO: 3369 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
araaraargayagyacy

SEQ ID NO: 3370 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (1)..(1): base is a locked nucleic acid
  modified_base (8)..(8): base is a locked nucleic acid
  modified_base (10)..(10): base is a locked nucleic acid
raaraargayagyacya

SEQ ID NO: 3371 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (2)..(2): base is a locked nucleic acid
  modified_base (8)..(8): base is a locked nucleic acid
  modified_base (10)..(10): base is a locked nucleic acid
aaraargayagyacyaa

SEQ ID NO: 3372 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
araaraargayagyacy

SEQ ID NO: 3373 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
raaraargayagyacya

SEQ ID NO: 3374 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
aaraargayagyacyaa

SEQ ID NO: 3375 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (11)..(11): base is a locked nucleic acid
araaraargayagya

SEQ ID NO: 3376 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (13)..(13): base is a locked nucleic acid
raaraargayagyac

SEQ ID NO: 3377 - DNA, 16 bp, Artificial Sequence
  Oligonucleotide probe
  misc_binding (1)..(16): Hybridization probe for the specific detection of wild-type HIV-1 at codon 67 of the reverse transcriptase gene.
aaraargayagyacya

SEQ ID NO: 3378 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
araaraargayagya

SEQ ID NO: 3379 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (11)..(11): base is a locked nucleic acid
raaraargayagyac

SEQ ID NO: 3380 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
aaraargayagyacy

SEQ ID NO: 3381 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (13)..(13): base is a locked nucleic acid
araaraargayagya

SEQ ID NO: 3382 - DNA, 16 bp, Artificial Sequence
  Oligonucleotide probe
  misc_binding (1)..(16): Hybridization probe for the specific detection of wild-type HIV-1 at codon 67 of the reverse transcriptase gene.
raaraargayagyacy

SEQ ID NO: 3383 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (10)..(10): base is a locked nucleic acid
araaraargayagya

SEQ ID NO: 3384 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
raaraargayagyac

SEQ ID NO: 3385 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (12)..(12): base is a locked nucleic acid
aaraargayagyacy

SEQ ID NO: 3386 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (3)..(3): base is a locked nucleic acid
araaraargayagya

SEQ ID NO: 3387 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (2)..(2): base is a locked nucleic acid
raaraargayagyac

SEQ ID NO: 3388 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (6)..(6): base is a locked nucleic acid
aaraargayagyacy

SEQ ID NO: 3389 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (7)..(7): base is a locked nucleic acid
araaraargayagya

SEQ ID NO: 3390 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (6)..(6): base is a locked nucleic acid
raaraargayagyac

SEQ ID NO: 3391 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (2)..(2): base is a locked nucleic acid
aaraargayagyacy

SEQ ID NO: 3392 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (2)..(2): base is a locked nucleic acid
araaraargayagya

SEQ ID NO: 3393 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (7)..(7): base is a locked nucleic acid
raaraargayagyac

SEQ ID NO: 3394 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (1)..(1): base is a locked nucleic acid
aaraargayagyacy

SEQ ID NO: 3395 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (6)..(6): base is a locked nucleic acid
araaraargayagya

SEQ ID NO: 3396 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (5)..(5): base is a locked nucleic acid
raaraargayagyac

SEQ ID NO: 3397 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (3)..(3): base is a locked nucleic acid
aaraargayagyacy

SEQ ID NO: 3398 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (11)..(11): base is a locked nucleic acid
araaraargayagya

SEQ ID NO: 3399 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (14)..(14): base is a locked nucleic acid
raaraargayagyac

SEQ ID NO: 3400 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (12)..(12): base is a locked nucleic acid
aaraargayagyacy

SEQ ID NO: 3401 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (13)..(13): base is a locked nucleic acid
araaraargayagya

SEQ ID NO: 3402 - DNA, 16 bp, Artificial Sequence
  Oligonucleotide probe
  misc_binding (1)..(16): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
raaraargayagyacy

SEQ ID NO: 3403 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (15)..(15): base is a locked nucleic acid
aaraargayagyacy

SEQ ID NO: 3404 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (15)..(15): base is a locked nucleic acid
araaraargayagya

SEQ ID NO: 3405 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (11)..(11): base is a locked nucleic acid
raaraargayagyac

SEQ ID NO: 3406 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (13)..(13): base is a locked nucleic acid
aaraargayagyacy

SEQ ID NO: 3407 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
araaraargayagya

SEQ ID NO: 3408 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (15)..(15): base is a locked nucleic acid
raaraargayagyac

SEQ ID NO: 3409 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (14)..(14): base is a locked nucleic acid
aaraargayagyacy

SEQ ID NO: 3410 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (4)..(4): base is a locked nucleic acid
  modified_base (8)..(8): base is a locked nucleic acid
  modified_base (10)..(10): base is a locked nucleic acid
araaraargayagya

SEQ ID NO: 3411 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (7)..(7): base is a locked nucleic acid
  modified_base (8)..(8): base is a locked nucleic acid
  modified_base (10)..(10): base is a locked nucleic acid
raaraargayagyac

SEQ ID NO: 3412 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (3)..(3): base is a locked nucleic acid
  modified_base (8)..(8): base is a locked nucleic acid
  modified_base (10)..(10): base is a locked nucleic acid
aaraargayagyacy

SEQ ID NO: 3413 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (2)..(2): base is a locked nucleic acid
  modified_base (8)..(8): base is a locked nucleic acid
  modified_base (10)..(10): base is a locked nucleic acid
araaraargayagya

SEQ ID NO: 3414 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (4)..(4): base is a locked nucleic acid
  modified_base (8)..(8): base is a locked nucleic acid
  modified_base (10)..(10): base is a locked nucleic acid
raaraargayagyac

SEQ ID NO: 3415 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
aaraargayagyacy

SEQ ID NO: 3416 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (3)..(3): base is a locked nucleic acid
  modified_base (8)..(8): base is a locked nucleic acid
  modified_base (10)..(10): base is a locked nucleic acid
araaraargayagya

SEQ ID NO: 3417 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
raaraargayagyac

SEQ ID NO: 3418 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (1)..(1): base is a locked nucleic acid
  modified_base (8)..(8): base is a locked nucleic acid
  modified_base (10)..(10): base is a locked nucleic acid
aaraargayagyacy

SEQ ID NO: 3419 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
araaraargayagya

SEQ ID NO: 3420 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (1)..(1): base is a locked nucleic acid
  modified_base (8)..(8): base is a locked nucleic acid
  modified_base (10)..(10): base is a locked nucleic acid
raaraargayagyac

SEQ ID NO: 3421 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (2)..(2): base is a locked nucleic acid
  modified_base (8)..(8): base is a locked nucleic acid
  modified_base (10)..(10): base is a locked nucleic acid
aaraargayagyacy

SEQ ID NO: 3422 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
araaraargayagya

SEQ ID NO: 3423 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
raaraargayagyac

SEQ ID NO: 3424 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
aaraargayagyacy

SEQ ID NO: 3425 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (11)..(11): base is a locked nucleic acid
araaraargayag

SEQ ID NO: 3426 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (13)..(13): base is a locked nucleic acid
raaraargayagy

SEQ ID NO: 3427 - DNA, 14 bp, Artificial Sequence
  Oligonucleotide probe
  misc_binding (1)..(14): Hybridization probe for the specific detection of wild-type HIV-1 at codon 67 of the reverse transcriptase gene.
aaraargayagyac

SEQ ID NO: 3428 - DNA, 14 bp, Artificial Sequence
  Oligonucleotide probe
  misc_binding (1)..(14): Hybridization probe for the specific detection of wild-type HIV-1 at codon 67 of the reverse transcriptase gene.
araaraargayagy

SEQ ID NO: 3429 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (11)..(11): base is a locked nucleic acid
raaraargayagy

SEQ ID NO: 3430 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (13)..(13): base is a locked nucleic acid
araaraargayag

SEQ ID NO: 3431 - DNA, 14 bp, Artificial Sequence
  Oligonucleotide probe
  misc_binding (1)..(14): Hybridization probe for the specific detection of wild-type HIV-1 at codon 67 of the reverse transcriptase gene.
raaraargayagya

SEQ ID NO: 3432 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (10)..(10): base is a locked nucleic acid
araaraargayag

SEQ ID NO: 3433 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (12)..(12): base is a locked nucleic acid
aaraargayagya

SEQ ID NO: 3434 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (3)..(3): base is a locked nucleic acid
araaraargayag

SEQ ID NO: 3435 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (2)..(2): base is a locked nucleic acid
raaraargayagy

SEQ ID NO: 3436 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (6)..(6): base is a locked nucleic acid
aaraargayagya

SEQ ID NO: 3437 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (7)..(7): base is a locked nucleic acid
araaraargayag

SEQ ID NO: 3438 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (6)..(6): base is a locked nucleic acid
raaraargayagy

SEQ ID NO: 3439 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (2)..(2): base is a locked nucleic acid
aaraargayagya

SEQ ID NO: 3440 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (2)..(2): base is a locked nucleic acid
araaraargayag

SEQ ID NO: 3441 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (7)..(7): base is a locked nucleic acid
raaraargayagy

SEQ ID NO: 3442 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (1)..(1): base is a locked nucleic acid
aaraargayagya

SEQ ID NO: 3443 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (6)..(6): base is a locked nucleic acid
araaraargayag

SEQ ID NO: 3444 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (5)..(5): base is a locked nucleic acid
raaraargayagy

SEQ ID NO: 3445 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (3)..(3): base is a locked nucleic acid
aaraargayagya

SEQ ID NO: 3446 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (11)..(11): base is a locked nucleic acid
araaraargayag

SEQ ID NO: 3447 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
raaraargayagy

SEQ ID NO: 3448 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (12)..(12): base is a locked nucleic acid
aaraargayagya

SEQ ID NO: 3449 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (13)..(13): base is a locked nucleic acid
araaraargayag

SEQ ID NO: 3450 - DNA, 14 bp, Artificial Sequence
  Oligonucleotide probe
  misc_binding (1)..(14): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
raaraargayagya

SEQ ID NO: 3451 - DNA, 14 bp, Artificial Sequence
  Oligonucleotide probe
  misc_binding (1)..(14): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
aaraargayagyac

SEQ ID NO: 3452 - DNA, 14 bp, Artificial Sequence
  Oligonucleotide probe
  misc_binding (1)..(14): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
araaraargayagy

SEQ ID NO: 3453 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (11)..(11): base is a locked nucleic acid
raaraargayagy

SEQ ID NO: 3454 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
  modified_base (13)..(13): base is a locked nucleic acid
aaraargayagya

SEQ ID NO: 3455 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
aaraargayagya

SEQ ID NO: 3456 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (4)..(4): base is a locked nucleic acid
  modified_base (8)..(8): base is a locked nucleic acid
  modified_base (10)..(10): base is a locked nucleic acid
araaraargayag

SEQ ID NO: 3457 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (7)..(7): base is a locked nucleic acid
  modified_base (8)..(8): base is a locked nucleic acid
  modified_base (10)..(10): base is a locked nucleic acid
raaraargayagy

SEQ ID NO: 3458 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (3)..(3): base is a locked nucleic acid
  modified_base (8)..(8): base is a locked nucleic acid
  modified_base (10)..(10): base is a locked nucleic acid
aaraargayagya

SEQ ID NO: 3459 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (2)..(2): base is a locked nucleic acid
  modified_base (8)..(8): base is a locked nucleic acid
  modified_base (10)..(10): base is a locked nucleic acid
araaraargayag

SEQ ID NO: 3460 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (4)..(4): base is a locked nucleic acid
  modified_base (8)..(8): base is a locked nucleic acid
  modified_base (10)..(10): base is a locked nucleic acid
raaraargayagy

SEQ ID NO: 3461 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
aaraargayagya

SEQ ID NO: 3462 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (3)..(3): base is a locked nucleic acid
  modified_base (8)..(8): base is a locked nucleic acid
  modified_base (10)..(10): base is a locked nucleic acid
araaraargayag

SEQ ID NO: 3463 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
raaraargayagy

SEQ ID NO: 3464 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (1)..(1): base is a locked nucleic acid
  modified_base (8)..(8): base is a locked nucleic acid
  modified_base (10)..(10): base is a locked nucleic acid
aaraargayagya

SEQ ID NO: 3465 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (6)..(6): base is a locked nucleic acid
  modified_base (8)..(8): base is a locked nucleic acid
  modified_base (10)..(10): base is a locked nucleic acid
araaraargayag

SEQ ID NO: 3466 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (1)..(1): base is a locked nucleic acid
  modified_base (8)..(8): base is a locked nucleic acid
  modified_base (10)..(10): base is a locked nucleic acid
raaraargayagy

SEQ ID NO: 3467 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (2)..(2): base is a locked nucleic acid
  modified_base (8)..(8): base is a locked nucleic acid
  modified_base (10)..(10): base is a locked nucleic acid
aaraargayagya

SEQ ID NO: 3468 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
araaraargayag

SEQ ID NO: 3469 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
raaraargayagy

SEQ ID NO: 3470 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
  modified_base (8)..(8): base is a locked nucleic acid
  modified_base (10)..(10): base is a locked nucleic acid
aaraargayagya

SEQ ID NO: 3471 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
gaaaaaagayagtac

SEQ ID NO: 3472 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
aaraaraargayagyacya

SEQ ID NO: 3473 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
araaraargayagyacyaa

SEQ ID NO: 3474 - DNA, 19 bp, Artificial Sequence
  Oligonucleotide probe
  misc_binding (1)..(19): Hybridization probe for the specific detection of wild-type HIV-1 at codon 67 of the reverse transcriptase gene.
raaraargayagyacyaar

SEQ ID NO: 3475 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
araaraargayagyacy

SEQ ID NO: 3476 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
raaraargayagyacya

SEQ ID NO: 3477 - DNA, 17 bp, Artificial Sequence
  Oligonucleotide probe
  misc_binding (1)..(17): Hybridization probe for the specific detection of wild-type HIV-1 at codon 67 of the reverse transcriptase gene.
aaraargayagyacyaa

SEQ ID NO: 3478 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
araaraargayagya

SEQ ID NO: 3479 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
raaraargayagyac

SEQ ID NO: 3480 - DNA, 15 bp, Artificial Sequence
  Oligonucleotide probe
  misc_binding (1)..(15): Hybridization probe for the specific detection of wild-type HIV-1 at codon 67 of the reverse transcriptase gene.
aaraargayagyacy

SEQ ID NO: 3481 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
araaraargayag

SEQ ID NO: 3482 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
raaraargayagy

SEQ ID NO: 3483 - DNA, 13 bp, Artificial Sequence
  Oligonucleotide probe
  misc_binding (1)..(13): Hybridization probe for the specific detection of wild-type HIV-1 at codon 67 of the reverse transcriptase gene.
aaraargayagya

SEQ ID NO: 3484 - DNA, 15 bp, Artificial Sequence
  Oligonucleotide probe
  misc_binding (1)..(15): Hybridization probe for the specific detection of wild-type HIV-1 at codon 69 of the reverse transcriptase gene.
ccatttdgtactgtc

SEQ ID NO: 3485 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (13)..(13): base is a locked nucleic acid
gayagyacyaartggagra

SEQ ID NO: 3486 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (12)..(12): base is a locked nucleic acid
ayagyacyaartggagraa

SEQ ID NO: 3487 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (17)..(17): base is a locked nucleic acid
gayagyacyaartggagra

SEQ ID NO: 3488 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (17)..(17): base is a locked nucleic acid
ayagyacyaartggagraa

SEQ ID NO: 3489 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (15)..(15): base is a locked nucleic acid
gayagyacyaartggagra

SEQ ID NO: 3490 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (14)..(14): base is a locked nucleic acid
ayagyacyaartggagraa

SEQ ID NO: 3491 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (11)..(11): base is a locked nucleic acid
gayagyacyaartggagra

SEQ ID NO: 3492 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (11)..(11): base is a locked nucleic acid
ayagyacyaartggagraa

SEQ ID NO: 3493 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (8)..(8): base is a locked nucleic acid
gayagyacyaartggagra

SEQ ID NO: 3494 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (4)..(4): base is a locked nucleic acid
ayagyacyaartggagraa

SEQ ID NO: 3495 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (7)..(7): base is a locked nucleic acid
gayagyacyaartggagra

SEQ ID NO: 3496 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (8)..(8): base is a locked nucleic acid
ayagyacyaartggagraa

SEQ ID NO: 3497 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
gayagyacyaartggagra

SEQ ID NO: 3498 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (3)..(3): base is a locked nucleic acid
ayagyacyaartggagraa

SEQ ID NO: 3499 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (6)..(6): base is a locked nucleic acid
gayagyacyaartggagra

SEQ ID NO: 3500 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (7)..(7): base is a locked nucleic acid
ayagyacyaartggagraa

SEQ ID NO: 3501 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (12)..(12): base is a locked nucleic acid
gayagyacyaartggagra

SEQ ID NO: 3502 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (12)..(12): base is a locked nucleic acid
ayagyacyaartggagraa

SEQ ID NO: 3503 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (13)..(13): base is a locked nucleic acid
gayagyacyaartggagra

SEQ ID NO: 3504 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (14)..(14): base is a locked nucleic acid
ayagyacyaartggagraa

SEQ ID NO: 3505 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (19)..(19): base is a locked nucleic acid
gayagyacyaartggagra

SEQ ID NO: 3506 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (16)..(16): base is a locked nucleic acid
ayagyacyaartggagraa

SEQ ID NO: 3507 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (14)..(14): base is a locked nucleic acid
gayagyacyaartggagra

SEQ ID NO: 3508 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
  modified_base (17)..(17): base is a locked nucleic acid
ayagyacyaartggagraa

SEQ ID NO: 3509 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (3)..(3): base is a locked nucleic acid
  modified_base (9)..(9): base is a locked nucleic acid
  modified_base (11)..(11): base is a locked nucleic acid
gayagyacyaartggagra

SEQ ID NO: 3510 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (5)..(5): base is a locked nucleic acid
  modified_base (9)..(9): base is a locked nucleic acid
  modified_base (11)..(11): base is a locked nucleic acid
ayagyacyaartggagraa

SEQ ID NO: 3511 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (4)..(4): base is a locked nucleic acid
  modified_base (9)..(9): base is a locked nucleic acid
  modified_base (11)..(11): base is a locked nucleic acid
gayagyacyaartggagra

SEQ ID NO: 3512 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (3)..(3): base is a locked nucleic acid
  modified_base (9)..(9): base is a locked nucleic acid
  modified_base (11)..(11): base is a locked nucleic acid
ayagyacyaartggagraa

SEQ ID NO: 3513 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (5)..(5): base is a locked nucleic acid
  modified_base (9)..(9): base is a locked nucleic acid
  modified_base (11)..(11): base is a locked nucleic acid
gayagyacyaartggagra

SEQ ID NO: 3514 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (4)..(4): base is a locked nucleic acid
  modified_base (9)..(9): base is a locked nucleic acid
  modified_base (11)..(11): base is a locked nucleic acid
ayagyacyaartggagraa

SEQ ID NO: 3515 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (6)..(6): base is a locked nucleic acid
  modified_base (9)..(9): base is a locked nucleic acid
  modified_base (11)..(11): base is a locked nucleic acid
gayagyacyaartggagra

SEQ ID NO: 3516 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (7)..(7): base is a locked nucleic acid
  modified_base (9)..(9): base is a locked nucleic acid
  modified_base (11)..(11): base is a locked nucleic acid
ayagyacyaartggagraa

SEQ ID NO: 3517 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
gayagyacyaartggagra

SEQ ID NO: 3518 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
  modified_base (9)..(9): base is a locked nucleic acid
  modified_base (11)..(11): base is a locked nucleic acid
ayagyacyaartggagraa

SEQ ID NO: 3519 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (12)..(12): base is a locked nucleic acid
ayagyacyaartggagr

SEQ ID NO: 3520 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (11)..(11): base is a locked nucleic acid
yagyacyaartggagra

SEQ ID NO: 3521 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (16)..(16): base is a locked nucleic acid
ayagyacyaartggagr

SEQ ID NO: 3522 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (16)..(16): base is a locked nucleic acid
yagyacyaartggagra

SEQ ID NO: 3523 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (14)..(14): base is a locked nucleic acid
ayagyacyaartggagr

SEQ ID NO: 3524 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (13)..(13): base is a locked nucleic acid
yagyacyaartggagra

SEQ ID NO: 3525 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (10)..(10): base is a locked nucleic acid
ayagyacyaartggagr

SEQ ID NO: 3526 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (10)..(10): base is a locked nucleic acid
yagyacyaartggagra

SEQ ID NO: 3527 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (7)..(7): base is a locked nucleic acid
ayagyacyaartggagr

SEQ ID NO: 3528 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (3)..(3): base is a locked nucleic acid
yagyacyaartggagra

SEQ ID NO: 3529 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (6)..(6): base is a locked nucleic acid
ayagyacyaartggagr

SEQ ID NO: 3530 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (7)..(7): base is a locked nucleic acid
yagyacyaartggagra

SEQ ID NO: 3531 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
ayagyacyaartggagr

SEQ ID NO: 3532 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (2)..(2): base is a locked nucleic acid
yagyacyaartggagra

SEQ ID NO: 3533 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (5)..(5): base is a locked nucleic acid
ayagyacyaartggagr

SEQ ID NO: 3534 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (6)..(6): base is a locked nucleic acid
yagyacyaartggagra

SEQ ID NO: 3535 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (11)..(11): base is a locked nucleic acid
ayagyacyaartggagr

SEQ ID NO: 3536 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (11)..(11): base is a locked nucleic acid
yagyacyaartggagra

SEQ ID NO: 3537 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (12)..(12): base is a locked nucleic acid
ayagyacyaartggagr

SEQ ID NO: 3538 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (13)..(13): base is a locked nucleic acid
yagyacyaartggagra

SEQ ID NO: 3539 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
ayagyacyaartggagr

SEQ ID NO: 3540 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (15)..(15): base is a locked nucleic acid
yagyacyaartggagra

SEQ ID NO: 3541 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (13)..(13): base is a locked nucleic acid
ayagyacyaartggagr

SEQ ID NO: 3542 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (16)..(16): base is a locked nucleic acid
yagyacyaartggagra

SEQ ID NO: 3543 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (2)..(2): base is a locked nucleic acid
  modified_base (8)..(8): base is a locked nucleic acid
  modified_base (10)..(10): base is a locked nucleic acid
ayagyacyaartggagr

SEQ ID NO: 3544 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (4)..(4): base is a locked nucleic acid
  modified_base (8)..(8): base is a locked nucleic acid
  modified_base (10)..(10): base is a locked nucleic acid
yagyacyaartggagra

SEQ ID NO: 3545 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (3)..(3): base is a locked nucleic acid
  modified_base (8)..(8): base is a locked nucleic acid
  modified_base (10)..(10): base is a locked nucleic acid
ayagyacyaartggagr

SEQ ID NO: 3546 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (2)..(2): base is a locked nucleic acid
  modified_base (8)..(8): base is a locked nucleic acid
  modified_base (10)..(10): base is a locked nucleic acid
yagyacyaartggagra

SEQ ID NO: 3547 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (4)..(4): base is a locked nucleic acid
  modified_base (8)..(8): base is a locked nucleic acid
  modified_base (10)..(10): base is a locked nucleic acid
ayagyacyaartggagr

SEQ ID NO: 3548 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (3)..(3): base is a locked nucleic acid
  modified_base (8)..(8): base is a locked nucleic acid
  modified_base (10)..(10): base is a locked nucleic acid
yagyacyaartggagra

SEQ ID NO: 3549 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (5)..(5): base is a locked nucleic acid
  modified_base (8)..(8): base is a locked nucleic acid
  modified_base (10)..(10): base is a locked nucleic acid
ayagyacyaartggagr

SEQ ID NO: 3550 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (6)..(6): base is a locked nucleic acid
  modified_base (8)..(8): base is a locked nucleic acid
  modified_base (10)..(10): base is a locked nucleic acid
yagyacyaartggagra

SEQ ID NO: 3551 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
ayagyacyaartggagr

SEQ ID NO: 3552 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
yagyacyaartggagra

SEQ ID NO: 3553 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (12)..(12): base is a locked nucleic acid
ayagyacyaartgga

SEQ ID NO: 3554 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (11)..(11): base is a locked nucleic acid
yagyacyaartggag

SEQ ID NO: 3555 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
ayagyacyaartgga

SEQ ID NO: 3556 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
yagyacyaartggag

SEQ ID NO: 3557 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (14)..(14): base is a locked nucleic acid
ayagyacyaartgga

SEQ ID NO: 3558 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (13)..(13): base is a locked nucleic acid
yagyacyaartggag

SEQ ID NO: 3559 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (10)..(10): base is a locked nucleic acid
ayagyacyaartgga

SEQ ID NO: 3560 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (10)..(10): base is a locked nucleic acid
yagyacyaartggag

SEQ ID NO: 3561 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (7)..(7): base is a locked nucleic acid
ayagyacyaartgga

SEQ ID NO: 3562 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (3)..(3): base is a locked nucleic acid
yagyacyaartggag

SEQ ID NO: 3563 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (6)..(6): base is a locked nucleic acid
ayagyacyaartgga

SEQ ID NO: 3564 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (7)..(7): base is a locked nucleic acid
yagyacyaartggag

SEQ ID NO: 3565 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
ayagyacyaartgga

SEQ ID NO: 3566 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (2)..(2): base is a locked nucleic acid
yagyacyaartggag

SEQ ID NO: 3567 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (5)..(5): base is a locked nucleic acid
ayagyacyaartgga

SEQ ID NO: 3568 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (6)..(6): base is a locked nucleic acid
yagyacyaartggag

SEQ ID NO: 3569 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (11)..(11): base is a locked nucleic acid
ayagyacyaartgga

SEQ ID NO: 3570 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (11)..(11): base is a locked nucleic acid
yagyacyaartggag

SEQ ID NO: 3571 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (12)..(12): base is a locked nucleic acid
ayagyacyaartgga

SEQ ID NO: 3572 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (13)..(13): base is a locked nucleic acid
yagyacyaartggag

SEQ ID NO: 3573 - DNA, 16 bp, Artificial Sequence
  Oligonucleotide probe
  misc_binding (1)..(16): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
ayagyacyaartggag

SEQ ID NO: 3574 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (15)..(15): base is a locked nucleic acid
yagyacyaartggag

SEQ ID NO: 3575 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (13)..(13): base is a locked nucleic acid
ayagyacyaartgga

SEQ ID NO: 3576 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
yagyacyaartggag

SEQ ID NO: 3577 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (2)..(2): base is a locked nucleic acid
  modified_base (8)..(8): base is a locked nucleic acid
  modified_base (10)..(10): base is a locked nucleic acid
ayagyacyaartgga

SEQ ID NO: 3578 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (4)..(4): base is a locked nucleic acid
  modified_base (8)..(8): base is a locked nucleic acid
  modified_base (10)..(10): base is a locked nucleic acid
yagyacyaartggag

SEQ ID NO: 3579 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (3)..(3): base is a locked nucleic acid
  modified_base (8)..(8): base is a locked nucleic acid
  modified_base (10)..(10): base is a locked nucleic acid
ayagyacyaartgga

SEQ ID NO: 3580 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (2)..(2): base is a locked nucleic acid
  modified_base (8)..(8): base is a locked nucleic acid
  modified_base (10)..(10): base is a locked nucleic acid
yagyacyaartggag

SEQ ID NO: 3581 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (4)..(4): base is a locked nucleic acid
  modified_base (8)..(8): base is a locked nucleic acid
  modified_base (10)..(10): base is a locked nucleic acid
ayagyacyaartgga

SEQ ID NO: 3582 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (3)..(3): base is a locked nucleic acid
  modified_base (8)..(8): base is a locked nucleic acid
  modified_base (10)..(10): base is a locked nucleic acid
yagyacyaartggag

SEQ ID NO: 3583 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (5)..(5): base is a locked nucleic acid
  modified_base (8)..(8): base is a locked nucleic acid
  modified_base (10)..(10): base is a locked nucleic acid
ayagyacyaartgga

SEQ ID NO: 3584 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (6)..(6): base is a locked nucleic acid
  modified_base (8)..(8): base is a locked nucleic acid
  modified_base (10)..(10): base is a locked nucleic acid
yagyacyaartggag

SEQ ID NO: 3585 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
ayagyacyaartgga

SEQ ID NO: 3586 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
yagyacyaartggag

SEQ ID NO: 3587 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (12)..(12): base is a locked nucleic acid
ayagyacyaartg

SEQ ID NO: 3588 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (11)..(11): base is a locked nucleic acid
yagyacyaartgg

SEQ ID NO: 3589 - DNA, 14 bp, Artificial Sequence
  Oligonucleotide probe
  misc_binding (1)..(14): Hybridization probe for the specific detection of wild-type HIV-1 at codon 70 of the reverse transcriptase gene.
ayagyacyaartgg

SEQ ID NO: 3590 - DNA, 14 bp, Artificial Sequence
  Oligonucleotide probe
  misc_binding (1)..(14): Hybridization probe for the specific detection of wild-type HIV-1 at codon 70 of the reverse transcriptase gene.
yagyacyaartgga

SEQ ID NO: 3591 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
ayagyacyaartg

SEQ ID NO: 3592 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (13)..(13): base is a locked nucleic acid
yagyacyaartgg

SEQ ID NO: 3593 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (10)..(10): base is a locked nucleic acid
ayagyacyaartg

SEQ ID NO: 3594 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (10)..(10): base is a locked nucleic acid
yagyacyaartgg

SEQ ID NO: 3595 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (7)..(7): base is a locked nucleic acid
ayagyacyaartg

SEQ ID NO: 3596 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (3)..(3): base is a locked nucleic acid
yagyacyaartgg

SEQ ID NO: 3597 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (6)..(6): base is a locked nucleic acid
ayagyacyaartg

SEQ ID NO: 3598 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (7)..(7): base is a locked nucleic acid
yagyacyaartgg

SEQ ID NO: 3599 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
ayagyacyaartg

SEQ ID NO: 3600 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (2)..(2): base is a locked nucleic acid
yagyacyaartgg

SEQ ID NO: 3601 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (5)..(5): base is a locked nucleic acid
ayagyacyaartg

SEQ ID NO: 3602 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (6)..(6): base is a locked nucleic acid
yagyacyaartgg

SEQ ID NO: 3603 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (11)..(11): base is a locked nucleic acid
ayagyacyaartg

SEQ ID NO: 3604 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (11)..(11): base is a locked nucleic acid
yagyacyaartgg

SEQ ID NO: 3605 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (12)..(12): base is a locked nucleic acid
ayagyacyaartg

SEQ ID NO: 3606 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (13)..(13): base is a locked nucleic acid
yagyacyaartgg

SEQ ID NO: 3607 - DNA, 14 bp, Artificial Sequence
  Oligonucleotide probe
  misc_binding (1)..(14): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
ayagyacyaartgg

SEQ ID NO: 3608 - DNA, 14 bp, Artificial Sequence
  Oligonucleotide probe
  misc_binding (1)..(14): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
yagyacyaartgga

SEQ ID NO: 3609 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
  modified_base (13)..(13): base is a locked nucleic acid
ayagyacyaartg

SEQ ID NO: 3610 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (2)..(2): base is a locked nucleic acid
  modified_base (8)..(8): base is a locked nucleic acid
  modified_base (10)..(10): base is a locked nucleic acid
ayagyacyaartg

SEQ ID NO: 3611 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (4)..(4): base is a locked nucleic acid
  modified_base (8)..(8): base is a locked nucleic acid
  modified_base (10)..(10): base is a locked nucleic acid
yagyacyaartgg

SEQ ID NO: 3612 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (3)..(3): base is a locked nucleic acid
  modified_base (8)..(8): base is a locked nucleic acid
  modified_base (10)..(10): base is a locked nucleic acid
ayagyacyaartg

SEQ ID NO: 3613 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (2)..(2): base is a locked nucleic acid
  modified_base (8)..(8): base is a locked nucleic acid
  modified_base (10)..(10): base is a locked nucleic acid
yagyacyaartgg

SEQ ID NO: 3614 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (4)..(4): base is a locked nucleic acid
  modified_base (8)..(8): base is a locked nucleic acid
  modified_base (10)..(10): base is a locked nucleic acid
ayagyacyaartg

SEQ ID NO: 3615 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (3)..(3): base is a locked nucleic acid
  modified_base (8)..(8): base is a locked nucleic acid
  modified_base (10)..(10): base is a locked nucleic acid
yagyacyaartgg

SEQ ID NO: 3616 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (5)..(5): base is a locked nucleic acid
  modified_base (8)..(8): base is a locked nucleic acid
  modified_base (10)..(10): base is a locked nucleic acid
ayagyacyaartg

SEQ ID NO: 3617 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (6)..(6): base is a locked nucleic acid
  modified_base (8)..(8): base is a locked nucleic acid
  modified_base (10)..(10): base is a locked nucleic acid
yagyacyaartgg

SEQ ID NO: 3618 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
ayagyacyaartg

SEQ ID NO: 3619 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
  modified_base (8)..(8): base is a locked nucleic acid
  modified_base (10)..(10): base is a locked nucleic acid
yagyacyaartgg

SEQ ID NO: 3620 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
cagtactaartggag

SEQ ID NO: 3621 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
gayagyacyaartggagra

SEQ ID NO: 3622 - DNA, 19 bp, Artificial Sequence
  Oligonucleotide probe
  misc_binding (1)..(19): Hybridization probe for the specific detection of wild-type HIV-1 at codon 70 of the reverse transcriptase gene.
ayagyacyaartggagraa

SEQ ID NO: 3623 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
ayagyacyaartggagr

SEQ ID NO: 3624 - DNA, 17 bp, Artificial Sequence
  Oligonucleotide probe
  misc_binding (1)..(17): Hybridization probe for the specific detection of wild-type HIV-1 at codon 70 of the reverse transcriptase gene.
yagyacyaartggagra

SEQ ID NO: 3625 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
ayagyacyaartgga

SEQ ID NO: 3626 - DNA, 15 bp, Artificial Sequence
  Oligonucleotide probe
  misc_binding (1)..(15): Hybridization probe for the specific detection of wild-type HIV-1 at codon 70 of the reverse transcriptase gene.
yagyacyaartggag

SEQ ID NO: 3627 - DNA, 16 bp, Artificial Sequence
  Oligonucleotide probe
  misc_binding (1)..(16): Hybridization probe for the specific detection of wild-type HIV-1 at codon 70 of the reverse transcriptase gene.
ayagyacyaartggag

SEQ ID NO: 3628 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
ayagyacyaartg

SEQ ID NO: 3629 - DNA, 13 bp, Artificial Sequence
  Oligonucleotide probe
  misc_binding (1)..(13): Hybridization probe for the specific detection of wild-type HIV-1 at codon 70 of the reverse transcriptase gene.
yagyacyaartgg

SEQ ID NO: 3630 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (13)..(13): base is a locked nucleic acid
tggagraaaytagtagayt

SEQ ID NO: 3631 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (12)..(12): base is a locked nucleic acid
tggagraaaytagtagayt

SEQ ID NO: 3632 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (19)..(19): base is a locked nucleic acid
tggagraaaytagtagayt

SEQ ID NO: 3633 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (14)..(14): base is a locked nucleic acid
tggagraaaytagtagayt

SEQ ID NO: 3634 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (9)..(9): base is a locked nucleic acid
tggagraaaytagtagayt

SEQ ID NO: 3635 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (2)..(2): base is a locked nucleic acid
tggagraaaytagtagayt

SEQ ID NO: 3636 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (8)..(8): base is a locked nucleic acid
tggagraaaytagtagayt

SEQ ID NO: 3637 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (3)..(3): base is a locked nucleic acid
tggagraaaytagtagayt

SEQ ID NO: 3638 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (9)..(9): base is a locked nucleic acid
  modified_base (11)..(11): base is a locked nucleic acid
  modified_base (13)..(13): base is a locked nucleic acid
tggagraaaytagtagayt

SEQ ID NO: 3639 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (9)..(9): base is a locked nucleic acid
  modified_base (11)..(11): base is a locked nucleic acid
  modified_base (15)..(15): base is a locked nucleic acid
tggagraaaytagtagayt

SEQ ID NO: 3640 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (9)..(9): base is a locked nucleic acid
  modified_base (11)..(11): base is a locked nucleic acid
  modified_base (16)..(16): base is a locked nucleic acid
tggagraaaytagtagayt

SEQ ID NO: 3641 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (9)..(9): base is a locked nucleic acid
  modified_base (11)..(11): base is a locked nucleic acid
  modified_base (19)..(19): base is a locked nucleic acid
tggagraaaytagtagayt

SEQ ID NO: 3642 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (2)..(2): base is a locked nucleic acid
  modified_base (9)..(9): base is a locked nucleic acid
  modified_base (11)..(11): base is a locked nucleic acid
tggagraaaytagtagayt

SEQ ID NO: 3643 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (4)..(4): base is a locked nucleic acid
  modified_base (9)..(9): base is a locked nucleic acid
  modified_base (11)..(11): base is a locked nucleic acid
tggagraaaytagtagayt

SEQ ID NO: 3644 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (5)..(5): base is a locked nucleic acid
  modified_base (9)..(9): base is a locked nucleic acid
  modified_base (11)..(11): base is a locked nucleic acid
tggagraaaytagtagayt

SEQ ID NO: 3645 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (3)..(3): base is a locked nucleic acid
  modified_base (9)..(9): base is a locked nucleic acid
  modified_base (11)..(11): base is a locked nucleic acid
tggagraaaytagtagayt

SEQ ID NO: 3646 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
  modified_base (9)..(9): base is a locked nucleic acid
  modified_base (11)..(11): base is a locked nucleic acid
tggagraaaytagtagayt

SEQ ID NO: 3647 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (12)..(12): base is a locked nucleic acid
ggagraaaytagtagay

SEQ ID NO: 3648 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (11)..(11): base is a locked nucleic acid
ggagraaaytagtagay

SEQ ID NO: 3649 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
ggagraaaytagtagay

SEQ ID NO: 3650 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (13)..(13): base is a locked nucleic acid
ggagraaaytagtagay

SEQ ID NO: 3651 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (8)..(8): base is a locked nucleic acid
ggagraaaytagtagay

SEQ ID NO: 3652 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (1)..(1): base is a locked nucleic acid
ggagraaaytagtagay

SEQ ID NO: 3653 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (7)..(7): base is a locked nucleic acid
ggagraaaytagtagay

SEQ ID NO: 3654 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (2)..(2): base is a locked nucleic acid
ggagraaaytagtagay

SEQ ID NO: 3655 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
  modified_base (12)..(12): base is a locked nucleic acid
ggagraaaytagtagay

SEQ ID NO: 3656 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
  modified_base (14)..(14): base is a locked nucleic acid
ggagraaaytagtagay

SEQ ID NO: 3657 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
  modified_base (15)..(15): base is a locked nucleic acid
ggagraaaytagtagay

SEQ ID NO: 3658 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
ggagraaaytagtagay

SEQ ID NO: 3659 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (1)..(1): base is a locked nucleic acid
  modified_base (8)..(8): base is a locked nucleic acid
  modified_base (10)..(10): base is a locked nucleic acid
ggagraaaytagtagay

SEQ ID NO: 3660 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (3)..(3): base is a locked nucleic acid
  modified_base (8)..(8): base is a locked nucleic acid
  modified_base (10)..(10): base is a locked nucleic acid
ggagraaaytagtagay

SEQ ID NO: 3661 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (4)..(4): base is a locked nucleic acid
  modified_base (8)..(8): base is a locked nucleic acid
  modified_base (10)..(10): base is a locked nucleic acid
ggagraaaytagtagay

SEQ ID NO: 3662 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (2)..(2): base is a locked nucleic acid
  modified_base (8)..(8): base is a locked nucleic acid
  modified_base (10)..(10): base is a locked nucleic acid
ggagraaaytagtagay

SEQ ID NO: 3663 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
ggagraaaytagtagay

SEQ ID NO: 3664 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (12)..(12): base is a locked nucleic acid
ggagraaaytagtag

SEQ ID NO: 3665 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (11)..(11): base is a locked nucleic acid
ggagraaaytagtag

SEQ ID NO: 3666 - DNA, 16 bp, Artificial Sequence
  Oligonucleotide probe
  misc_binding (1)..(16): Hybridization probe for the specific detection of wild-type HIV-1 at codon 74 of the reverse transcriptase gene.
ggagraaaytagtaga

SEQ ID NO: 3667 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (13)..(13): base is a locked nucleic acid
ggagraaaytagtag

SEQ ID NO: 3668 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (8)..(8): base is a locked nucleic acid
ggagraaaytagtag

SEQ ID NO: 3669 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (1)..(1): base is a locked nucleic acid
ggagraaaytagtag

SEQ ID NO: 3670 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (7)..(7): base is a locked nucleic acid
ggagraaaytagtag

SEQ ID NO: 3671 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (2)..(2): base is a locked nucleic acid
ggagraaaytagtag

SEQ ID NO: 3672 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
  modified_base (12)..(12): base is a locked nucleic acid
ggagraaaytagtag

SEQ ID NO: 3673 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
  modified_base (14)..(14): base is a locked nucleic acid
ggagraaaytagtag

SEQ ID NO: 3674 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
  modified_base (15)..(15): base is a locked nucleic acid
ggagraaaytagtag

SEQ ID NO: 3675 - DNA, 16 bp, Artificial Sequence
  Oligonucleotide probe
  misc_binding (1)..(16): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
ggagraaaytagtaga

SEQ ID NO: 3676 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (1)..(1): base is a locked nucleic acid
  modified_base (8)..(8): base is a locked nucleic acid
  modified_base (10)..(10): base is a locked nucleic acid
ggagraaaytagtag

SEQ ID NO: 3677 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (3)..(3): base is a locked nucleic acid
  modified_base (8)..(8): base is a locked nucleic acid
  modified_base (10)..(10): base is a locked nucleic acid
ggagraaaytagtag

SEQ ID NO: 3678 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (4)..(4): base is a locked nucleic acid
  modified_base (8)..(8): base is a locked nucleic acid
  modified_base (10)..(10): base is a locked nucleic acid
ggagraaaytagtag

SEQ ID NO: 3679 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (2)..(2): base is a locked nucleic acid
  modified_base (8)..(8): base is a locked nucleic acid
  modified_base (10)..(10): base is a locked nucleic acid
ggagraaaytagtag

SEQ ID NO: 3680 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
ggagraaaytagtag

SEQ ID NO: 3681 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (12)..(12): base is a locked nucleic acid
ggagraaaytagt

SEQ ID NO: 3682 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (11)..(11): base is a locked nucleic acid
ggagraaaytagt

SEQ ID NO: 3683 - DNA, 14 bp, Artificial Sequence
  Oligonucleotide probe
  misc_binding (1)..(14): Hybridization probe for the specific detection of wild-type HIV-1 at codon 74 of the reverse transcriptase gene.
ggagraaaytagta

SEQ ID NO: 3684 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (13)..(13): base is a locked nucleic acid
ggagraaaytagt

SEQ ID NO: 3685 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (8)..(8): base is a locked nucleic acid
ggagraaaytagt

SEQ ID NO: 3686 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (1)..(1): base is a locked nucleic acid
ggagraaaytagt

SEQ ID NO: 3687 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (7)..(7): base is a locked nucleic acid
ggagraaaytagt

SEQ ID NO: 3688 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (2)..(2): base is a locked nucleic acid
ggagraaaytagt

SEQ ID NO: 3689 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
  modified_base (12)..(12): base is a locked nucleic acid
ggagraaaytagt

SEQ ID NO: 3690 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
ggagraaaytagt

SEQ ID NO: 3691 - DNA, 14 bp, Artificial Sequence
  Oligonucleotide probe
  misc_binding (1)..(14): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
ggagraaaytagta

SEQ ID NO: 3692 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (1)..(1): base is a locked nucleic acid
  modified_base (8)..(8): base is a locked nucleic acid
  modified_base (10)..(10): base is a locked nucleic acid
ggagraaaytagt

SEQ ID NO: 3693 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (3)..(3): base is a locked nucleic acid
  modified_base (8)..(8): base is a locked nucleic acid
  modified_base (10)..(10): base is a locked nucleic acid
ggagraaaytagt

SEQ ID NO: 3694 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (4)..(4): base is a locked nucleic acid
  modified_base (8)..(8): base is a locked nucleic acid
  modified_base (10)..(10): base is a locked nucleic acid
ggagraaaytagt

SEQ ID NO: 3695 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (2)..(2): base is a locked nucleic acid
  modified_base (8)..(8): base is a locked nucleic acid
  modified_base (10)..(10): base is a locked nucleic acid
ggagraaaytagt

SEQ ID NO: 3696 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
  modified_base (8)..(8): base is a locked nucleic acid
  modified_base (10)..(10): base is a locked nucleic acid
ggagraaaytagt

SEQ ID NO: 3697 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
atctacyarttttct

SEQ ID NO: 3698 - DNA, 19 bp, Artificial Sequence
  Oligonucleotide probe
  misc_binding (1)..(19): Hybridization probe for the specific detection of wild-type HIV-1 at codon 74 of the reverse transcriptase gene.
tggagraaaytagtagayt

SEQ ID NO: 3699 - DNA, 17 bp, Artificial Sequence
  Oligonucleotide probe
  misc_binding (1)..(17): Hybridization probe for the specific detection of wild-type HIV-1 at codon 74 of the reverse transcriptase gene.
ggagraaaytagtagay

SEQ ID NO: 3700 - DNA, 15 bp, Artificial Sequence
  Oligonucleotide probe
  misc_binding (1)..(15): Hybridization probe for the specific detection of wild-type HIV-1 at codon 74 of the reverse transcriptase gene.
ggagraaaytagtag

SEQ ID NO: 3701 - DNA, 13 bp, Artificial Sequence
  Oligonucleotide probe
  misc_binding (1)..(13): Hybridization probe for the specific detection of wild-type HIV-1 at codon 74 of the reverse transcriptase gene.
ggagraaaytagt

SEQ ID NO: 3702 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (12)..(12): base is a locked nucleic acid
agraaattagtagayttya

SEQ ID NO: 3703 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (13)..(13): base is a locked nucleic acid
graaattagtagayttyag

SEQ ID NO: 3704 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (11)..(11): base is a locked nucleic acid
agraaattagtagayttya

SEQ ID NO: 3705 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (12)..(12): base is a locked nucleic acid
graaattagtagayttyag

SEQ ID NO: 3706 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (17)..(17): base is a locked nucleic acid
agraaattagtagayttya

SEQ ID NO: 3707 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (19)..(19): base is a locked nucleic acid
graaattagtagayttyag

SEQ ID NO: 3708 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (16)..(16): base is a locked nucleic acid
agraaattagtagayttya

SEQ ID NO: 3709 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (14)..(14): base is a locked nucleic acid
graaattagtagayttyag

SEQ ID NO: 3710 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (5)..(5): base is a locked nucleic acid
agraaattagtagayttya

SEQ ID NO: 3711 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
graaattagtagayttyag

SEQ ID NO: 3712 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (4)..(4): base is a locked nucleic acid
agraaattagtagayttya

SEQ ID NO: 3713 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (2)..(2): base is a locked nucleic acid
graaattagtagayttyag

SEQ ID NO: 3714 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (7)..(7): base is a locked nucleic acid
agraaattagtagayttya

SEQ ID NO: 3715 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (8)..(8): base is a locked nucleic acid
graaattagtagayttyag

SEQ ID NO: 3716 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (2)..(2): base is a locked nucleic acid
agraaattagtagayttya

SEQ ID NO: 3717 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (3)..(3): base is a locked nucleic acid
graaattagtagayttyag

SEQ ID NO: 3718 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (14)..(14): base is a locked nucleic acid
agraaattagtagayttya

SEQ ID NO: 3719 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (13)..(13): base is a locked nucleic acid
graaattagtagayttyag

SEQ ID NO: 3720 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (18)..(18): base is a locked nucleic acid
agraaattagtagayttya

SEQ ID NO: 3721 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (15)..(15): base is a locked nucleic acid
graaattagtagayttyag

SEQ ID NO: 3722 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (15)..(15): base is a locked nucleic acid
agraaattagtagayttya

SEQ ID NO: 3723 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (16)..(16): base is a locked nucleic acid
graaattagtagayttyag

SEQ ID NO: 3724 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (12)..(12): base is a locked nucleic acid
agraaattagtagayttya

SEQ ID NO: 3725 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
  modified_base (19)..(19): base is a locked nucleic acid
graaattagtagayttyag

SEQ ID NO: 3726 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (7)..(7): base is a locked nucleic acid
  modified_base (9)..(9): base is a locked nucleic acid
  modified_base (11)..(11): base is a locked nucleic acid
agraaattagtagayttya

SEQ ID NO: 3727 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (2)..(2): base is a locked nucleic acid
  modified_base (9)..(9): base is a locked nucleic acid
  modified_base (11)..(11): base is a locked nucleic acid
graaattagtagayttyag

SEQ ID NO: 3728 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (3)..(3): base is a locked nucleic acid
  modified_base (9)..(9): base is a locked nucleic acid
  modified_base (11)..(11): base is a locked nucleic acid
agraaattagtagayttya

SEQ ID NO: 3729 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (4)..(4): base is a locked nucleic acid
  modified_base (9)..(9): base is a locked nucleic acid
  modified_base (11)..(11): base is a locked nucleic acid
graaattagtagayttyag

SEQ ID NO: 3730 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (8)..(8): base is a locked nucleic acid
  modified_base (9)..(9): base is a locked nucleic acid
  modified_base (11)..(11): base is a locked nucleic acid
agraaattagtagayttya

SEQ ID NO: 3731 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (5)..(5): base is a locked nucleic acid
  modified_base (9)..(9): base is a locked nucleic acid
  modified_base (11)..(11): base is a locked nucleic acid
graaattagtagayttyag

SEQ ID NO: 3732 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (2)..(2): base is a locked nucleic acid
  modified_base (9)..(9): base is a locked nucleic acid
  modified_base (11)..(11): base is a locked nucleic acid
agraaattagtagayttya

SEQ ID NO: 3733 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (3)..(3): base is a locked nucleic acid
  modified_base (9)..(9): base is a locked nucleic acid
  modified_base (11)..(11): base is a locked nucleic acid
graaattagtagayttyag

SEQ ID NO: 3734 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
agraaattagtagayttya

SEQ ID NO: 3735 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
  modified_base (9)..(9): base is a locked nucleic acid
  modified_base (11)..(11): base is a locked nucleic acid
graaattagtagayttyag

SEQ ID NO: 3736 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (11)..(11): base is a locked nucleic acid
graaattagtagaytty

SEQ ID NO: 3737 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (12)..(12): base is a locked nucleic acid
raaattagtagayttya

SEQ ID NO: 3738 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (10)..(10): base is a locked nucleic acid
graaattagtagaytty

SEQ ID NO: 3739 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (11)..(11): base is a locked nucleic acid
raaattagtagayttya

SEQ ID NO: 3740 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (16)..(16): base is a locked nucleic acid
graaattagtagaytty

SEQ ID NO: 3741 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
raaattagtagayttya

SEQ ID NO: 3742 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (15)..(15): base is a locked nucleic acid
graaattagtagaytty

SEQ ID NO: 3743 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (13)..(13): base is a locked nucleic acid
raaattagtagayttya

SEQ ID NO: 3744 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (4)..(4): base is a locked nucleic acid
graaattagtagaytty

SEQ ID NO: 3745 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
raaattagtagayttya

SEQ ID NO: 3746 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (3)..(3): base is a locked nucleic acid
graaattagtagaytty

SEQ ID NO: 3747 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (1)..(1): base is a locked nucleic acid
raaattagtagayttya

SEQ ID NO: 3748 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (6)..(6): base is a locked nucleic acid
graaattagtagaytty

SEQ ID NO: 3749 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (7)..(7): base is a locked nucleic acid
raaattagtagayttya

SEQ ID NO: 3750 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (1)..(1): base is a locked nucleic acid
graaattagtagaytty

SEQ ID NO: 3751 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (2)..(2): base is a locked nucleic acid
raaattagtagayttya

SEQ ID NO: 3752 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (13)..(13): base is a locked nucleic acid
graaattagtagaytty

SEQ ID NO: 3753 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (12)..(12): base is a locked nucleic acid
raaattagtagayttya

SEQ ID NO: 3754 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (17)..(17): base is a locked nucleic acid
graaattagtagaytty

SEQ ID NO: 3755 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (14)..(14): base is a locked nucleic acid
raaattagtagayttya

SEQ ID NO: 3756 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (14)..(14): base is a locked nucleic acid
graaattagtagaytty

SEQ ID NO: 3757 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (15)..(15): base is a locked nucleic acid
raaattagtagayttya

SEQ ID NO: 3758 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (11)..(11): base is a locked nucleic acid
graaattagtagaytty

SEQ ID NO: 3759 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
raaattagtagayttya

SEQ ID NO: 3760 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (6)..(6): base is a locked nucleic acid
  modified_base (8)..(8): base is a locked nucleic acid
  modified_base (10)..(10): base is a locked nucleic acid
graaattagtagaytty

SEQ ID NO: 3761 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (1)..(1): base is a locked nucleic acid
  modified_base (8)..(8): base is a locked nucleic acid
  modified_base (10)..(10): base is a locked nucleic acid
raaattagtagayttya

SEQ ID NO: 3762 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (2)..(2): base is a locked nucleic acid
  modified_base (8)..(8): base is a locked nucleic acid
  modified_base (10)..(10): base is a locked nucleic acid
graaattagtagaytty

SEQ ID NO: 3763 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (3)..(3): base is a locked nucleic acid
  modified_base (8)..(8): base is a locked nucleic acid
  modified_base (10)..(10): base is a locked nucleic acid
raaattagtagayttya

SEQ ID NO: 3764 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (7)..(7): base is a locked nucleic acid
  modified_base (8)..(8): base is a locked nucleic acid
  modified_base (10)..(10): base is a locked nucleic acid
graaattagtagaytty

SEQ ID NO: 3765 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (4)..(4): base is a locked nucleic acid
  modified_base (8)..(8): base is a locked nucleic acid
  modified_base (10)..(10): base is a locked nucleic acid
raaattagtagayttya

SEQ ID NO: 3766 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (1)..(1): base is a locked nucleic acid
  modified_base (8)..(8): base is a locked nucleic acid
  modified_base (10)..(10): base is a locked nucleic acid
graaattagtagaytty

SEQ ID NO: 3767 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (2)..(2): base is a locked nucleic acid
  modified_base (8)..(8): base is a locked nucleic acid
  modified_base (10)..(10): base is a locked nucleic acid
raaattagtagayttya

SEQ ID NO: 3768 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
graaattagtagaytty

SEQ ID NO: 3769 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
raaattagtagayttya

SEQ ID NO: 3770 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (11)..(11): base is a locked nucleic acid
graaattagtagayt

SEQ ID NO: 3771 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (12)..(12): base is a locked nucleic acid
raaattagtagaytt

SEQ ID NO: 3772 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (10)..(10): base is a locked nucleic acid
graaattagtagayt

SEQ ID NO: 3773 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (11)..(11): base is a locked nucleic acid
raaattagtagaytt

SEQ ID NO: 3774 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
graaattagtagayt

SEQ ID NO: 3775 - DNA, 16 bp, Artificial Sequence
  Oligonucleotide probe
  misc_binding (1)..(16): Hybridization probe for the specific detection of wild-type HIV-1 at codon 75 of the reverse transcriptase gene.
raaattagtagaytty

SEQ ID NO: 3776 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (15)..(15): base is a locked nucleic acid
graaattagtagayt

SEQ ID NO: 3777 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (13)..(13): base is a locked nucleic acid
raaattagtagaytt

SEQ ID NO: 3778 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (4)..(4): base is a locked nucleic acid
graaattagtagayt

SEQ ID NO: 3779 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
raaattagtagaytt

SEQ ID NO: 3780 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (3)..(3): base is a locked nucleic acid
graaattagtagayt

SEQ ID NO: 3781 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (1)..(1): base is a locked nucleic acid
raaattagtagaytt

SEQ ID NO: 3782 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (6)..(6): base is a locked nucleic acid
graaattagtagayt

SEQ ID NO: 3783 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (7)..(7): base is a locked nucleic acid
raaattagtagaytt

SEQ ID NO: 3784 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (1)..(1): base is a locked nucleic acid
graaattagtagayt

SEQ ID NO: 3785 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (2)..(2): base is a locked nucleic acid
raaattagtagaytt

SEQ ID NO: 3786 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (13)..(13): base is a locked nucleic acid
graaattagtagayt

SEQ ID NO: 3787 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (12)..(12): base is a locked nucleic acid
raaattagtagaytt

SEQ ID NO: 3788 - DNA, 16 bp, Artificial Sequence
  Oligonucleotide probe
  misc_binding (1)..(16): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
graaattagtagaytt

SEQ ID NO: 3789 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (14)..(14): base is a locked nucleic acid
raaattagtagaytt

SEQ ID NO: 3790 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (14)..(14): base is a locked nucleic acid
graaattagtagayt

SEQ ID NO: 3791 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (15)..(15): base is a locked nucleic acid
raaattagtagaytt

SEQ ID NO: 3792 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (11)..(11): base is a locked nucleic acid
graaattagtagayt

SEQ ID NO: 3793 - DNA, 16 bp, Artificial Sequence
  Oligonucleotide probe
  misc_binding (1)..(16): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
raaattagtagaytty

SEQ ID NO: 3794 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (6)..(6): base is a locked nucleic acid
  modified_base (8)..(8): base is a locked nucleic acid
  modified_base (10)..(10): base is a locked nucleic acid
graaattagtagayt

SEQ ID NO: 3795 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (1)..(1): base is a locked nucleic acid
  modified_base (8)..(8): base is a locked nucleic acid
  modified_base (10)..(10): base is a locked nucleic acid
raaattagtagaytt

SEQ ID NO: 3796 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (2)..(2): base is a locked nucleic acid
  modified_base (8)..(8): base is a locked nucleic acid
  modified_base (10)..(10): base is a locked nucleic acid
graaattagtagayt

SEQ ID NO: 3797 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (3)..(3): base is a locked nucleic acid
  modified_base (8)..(8): base is a locked nucleic acid
  modified_base (10)..(10): base is a locked nucleic acid
raaattagtagaytt

SEQ ID NO: 3798 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (7)..(7): base is a locked nucleic acid
  modified_base (8)..(8): base is a locked nucleic acid
  modified_base (10)..(10): base is a locked nucleic acid
graaattagtagayt

SEQ ID NO: 3799 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (4)..(4): base is a locked nucleic acid
  modified_base (8)..(8): base is a locked nucleic acid
  modified_base (10)..(10): base is a locked nucleic acid
raaattagtagaytt

SEQ ID NO: 3800 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (1)..(1): base is a locked nucleic acid
  modified_base (8)..(8): base is a locked nucleic acid
  modified_base (10)..(10): base is a locked nucleic acid
graaattagtagayt

SEQ ID NO: 3801 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (2)..(2): base is a locked nucleic acid
  modified_base (8)..(8): base is a locked nucleic acid
  modified_base (10)..(10): base is a locked nucleic acid
raaattagtagaytt

SEQ ID NO: 3802 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
graaattagtagayt

SEQ ID NO: 3803 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
raaattagtagaytt

SEQ ID NO: 3804 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (11)..(11): base is a locked nucleic acid
graaattagtaga

SEQ ID NO: 3805 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (12)..(12): base is a locked nucleic acid
raaattagtagay

SEQ ID NO: 3806 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (10)..(10): base is a locked nucleic acid
graaattagtaga

SEQ ID NO: 3807 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (11)..(11): base is a locked nucleic acid
raaattagtagay

SEQ ID NO: 3808 - DNA, 14 bp, Artificial Sequence
  Oligonucleotide probe
  misc_binding (1)..(14): Hybridization probe for the specific detection of wild-type HIV-1 at codon 75 of the reverse transcriptase gene.
graaattagtagay

SEQ ID NO: 3809 - DNA, 14 bp, Artificial Sequence
  Oligonucleotide probe
  misc_binding (1)..(14): Hybridization probe for the specific detection of wild-type HIV-1 at codon 75 of the reverse transcriptase gene.
raaattagtagayt

SEQ ID NO: 3810 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (13)..(13): base is a locked nucleic acid
raaattagtagay

SEQ ID NO: 3811 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (4)..(4): base is a locked nucleic acid
graaattagtaga

SEQ ID NO: 3812 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
raaattagtagay

SEQ ID NO: 3813 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (3)..(3): base is a locked nucleic acid
graaattagtaga

SEQ ID NO: 3814 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (1)..(1): base is a locked nucleic acid
raaattagtagay

SEQ ID NO: 3815 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (6)..(6): base is a locked nucleic acid
graaattagtaga

SEQ ID NO: 3816 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (7)..(7): base is a locked nucleic acid
raaattagtagay

SEQ ID NO: 3817 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (1)..(1): base is a locked nucleic acid
graaattagtaga

SEQ ID NO: 3818 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (2)..(2): base is a locked nucleic acid
raaattagtagay

SEQ ID NO: 3819 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (13)..(13): base is a locked nucleic acid
graaattagtaga

SEQ ID NO: 3820 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (12)..(12): base is a locked nucleic acid
raaattagtagay

SEQ ID NO: 3821 - DNA, 14 bp, Artificial Sequence
  Oligonucleotide probe
  misc_binding (1)..(14): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
graaattagtagay

SEQ ID NO: 3822 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
raaattagtagay

SEQ ID NO: 3823 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
graaattagtaga

SEQ ID NO: 3824 - DNA, 14 bp, Artificial Sequence
  Oligonucleotide probe
  misc_binding (1)..(14): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
raaattagtagayt

SEQ ID NO: 3825 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
  modified_base (11)..(11): base is a locked nucleic acid
graaattagtaga

SEQ ID NO: 3826 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (6)..(6): base is a locked nucleic acid
  modified_base (8)..(8): base is a locked nucleic acid
  modified_base (10)..(10): base is a locked nucleic acid
graaattagtaga

SEQ ID NO: 3827 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (1)..(1): base is a locked nucleic acid
  modified_base (8)..(8): base is a locked nucleic acid
  modified_base (10)..(10): base is a locked nucleic acid
raaattagtagay

SEQ ID NO: 3828 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (2)..(2): base is a locked nucleic acid
  modified_base (8)..(8): base is a locked nucleic acid
  modified_base (10)..(10): base is a locked nucleic acid
graaattagtaga

SEQ ID NO: 3829 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (3)..(3): base is a locked nucleic acid
  modified_base (8)..(8): base is a locked nucleic acid
  modified_base (10)..(10): base is a locked nucleic acid
raaattagtagay

SEQ ID NO: 3830 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (7)..(7): base is a locked nucleic acid
  modified_base (8)..(8): base is a locked nucleic acid
  modified_base (10)..(10): base is a locked nucleic acid
graaattagtaga

SEQ ID NO: 3831 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (4)..(4): base is a locked nucleic acid
  modified_base (8)..(8): base is a locked nucleic acid
  modified_base (10)..(10): base is a locked nucleic acid
raaattagtagay

SEQ ID NO: 3832 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (1)..(1): base is a locked nucleic acid
  modified_base (8)..(8): base is a locked nucleic acid
  modified_base (10)..(10): base is a locked nucleic acid
graaattagtaga

SEQ ID NO: 3833 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (2)..(2): base is a locked nucleic acid
  modified_base (8)..(8): base is a locked nucleic acid
  modified_base (10)..(10): base is a locked nucleic acid
raaattagtagay

SEQ ID NO: 3834 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
graaattagtaga

SEQ ID NO: 3835 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
  modified_base (8)..(8): base is a locked nucleic acid
  modified_base (10)..(10): base is a locked nucleic acid
raaattagtagay

SEQ ID NO: 3836 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
aaattagtrgatttc

SEQ ID NO: 3837 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
agraaattagtagayttya

SEQ ID NO: 3838 - DNA, 19 bp, Artificial Sequence
  Oligonucleotide probe
  misc_binding (1)..(19): Hybridization probe for the specific detection of wild-type HIV-1 at codon 75 of the reverse transcriptase gene.
graaattagtagayttyag

SEQ ID NO: 3839 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
graaattagtagaytty

SEQ ID NO: 3840 - DNA, 17 bp, Artificial Sequence
  Oligonucleotide probe
  misc_binding (1)..(17): Hybridization probe for the specific detection of wild-type HIV-1 at codon 75 of the reverse transcriptase gene.
raaattagtagayttya

SEQ ID NO: 3841 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
graaattagtagayt

SEQ ID NO: 3842 - DNA, 15 bp, Artificial Sequence
  Oligonucleotide probe
  misc_binding (1)..(15): Hybridization probe for the specific detection of wild-type HIV-1 at codon 75 of the reverse transcriptase gene.
raaattagtagaytt

SEQ ID NO: 3843 - DNA, 16 bp, Artificial Sequence
  Oligonucleotide probe
  misc_binding (1)..(16): Hybridization probe for the specific detection of wild-type HIV-1 at codon 75 of the reverse transcriptase gene.
graaattagtagaytt

SEQ ID NO: 3844 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
graaattagtaga

SEQ ID NO: 3845 - DNA, 13 bp, Artificial Sequence
  Oligonucleotide probe
  misc_binding (1)..(13): Hybridization probe for the specific detection of wild-type HIV-1 at codon 75 of the reverse transcriptase gene.
raaattagtagay

SEQ ID NO: 3846 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (19)..(19): base is a locked nucleic acid
agtagayttyagrgarcty

SEQ ID NO: 3847 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (12)..(12): base is a locked nucleic acid
agtagayttyagrgarcty

SEQ ID NO: 3848 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (13)..(13): base is a locked nucleic acid
agtagayttyagrgarcty

SEQ ID NO: 3849 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (15)..(15): base is a locked nucleic acid
agtagayttyagrgarcty

SEQ ID NO: 3850 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (5)..(5): base is a locked nucleic acid
agtagayttyagrgarcty

SEQ ID NO: 3851 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (3)..(3): base is a locked nucleic acid
agtagayttyagrgarcty

SEQ ID NO: 3852 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (2)..(2): base is a locked nucleic acid
agtagayttyagrgarcty

SEQ ID NO: 3853 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (8)..(8): base is a locked nucleic acid
agtagayttyagrgarcty

SEQ ID NO: 3854 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (9)..(9): base is a locked nucleic acid
  modified_base (11)..(11): base is a locked nucleic acid
  modified_base (13)..(13): base is a locked nucleic acid
agtagayttyagrgarcty

SEQ ID NO: 3855 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (9)..(9): base is a locked nucleic acid
  modified_base (11)..(11): base is a locked nucleic acid
  modified_base (14)..(14): base is a locked nucleic acid
agtagayttyagrgarcty

SEQ ID NO: 3856 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (9)..(9): base is a locked nucleic acid
  modified_base (11)..(11): base is a locked nucleic acid
  modified_base (19)..(19): base is a locked nucleic acid
agtagayttyagrgarcty

SEQ ID NO: 3857 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (9)..(9): base is a locked nucleic acid
  modified_base (11)..(11): base is a locked nucleic acid
  modified_base (15)..(15): base is a locked nucleic acid
agtagayttyagrgarcty

SEQ ID NO: 3858 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (7)..(7): base is a locked nucleic acid
  modified_base (9)..(9): base is a locked nucleic acid
  modified_base (11)..(11): base is a locked nucleic acid
agtagayttyagrgarcty

SEQ ID NO: 3859 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (2)..(2): base is a locked nucleic acid
  modified_base (9)..(9): base is a locked nucleic acid
  modified_base (11)..(11): base is a locked nucleic acid
agtagayttyagrgarcty

SEQ ID NO: 3860 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (5)..(5): base is a locked nucleic acid
  modified_base (9)..(9): base is a locked nucleic acid
  modified_base (11)..(11): base is a locked nucleic acid
agtagayttyagrgarcty

SEQ ID NO: 3861 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (8)..(8): base is a locked nucleic acid
  modified_base (9)..(9): base is a locked nucleic acid
  modified_base (11)..(11): base is a locked nucleic acid
agtagayttyagrgarcty

SEQ ID NO: 3862 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
  modified_base (9)..(9): base is a locked nucleic acid
  modified_base (11)..(11): base is a locked nucleic acid
agtagayttyagrgarcty

SEQ ID NO: 3863 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
gtagayttyagrgarct

SEQ ID NO: 3864 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (11)..(11): base is a locked nucleic acid
gtagayttyagrgarct

SEQ ID NO: 3865 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (12)..(12): base is a locked nucleic acid
gtagayttyagrgarct

SEQ ID NO: 3866 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (14)..(14): base is a locked nucleic acid
gtagayttyagrgarct

SEQ ID NO: 3867 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (4)..(4): base is a locked nucleic acid
gtagayttyagrgarct

SEQ ID NO: 3868 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (2)..(2): base is a locked nucleic acid
gtagayttyagrgarct

SEQ ID NO: 3869 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (1)..(1): base is a locked nucleic acid
gtagayttyagrgarct

SEQ ID NO: 3870 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (7)..(7): base is a locked nucleic acid
gtagayttyagrgarct

SEQ ID NO: 3871 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (12)..(12): base is a locked nucleic acid
gtagayttyagrgarct

SEQ ID NO: 3872 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (13)..(13): base is a locked nucleic acid
gtagayttyagrgarct

SEQ ID NO: 3873 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
gtagayttyagrgarct

SEQ ID NO: 3874 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (14)..(14): base is a locked nucleic acid
gtagayttyagrgarct

SEQ ID NO: 3875 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (6)..(6): base is a locked nucleic acid
  modified_base (8)..(8): base is a locked nucleic acid
  modified_base (10)..(10): base is a locked nucleic acid
gtagayttyagrgarct

SEQ ID NO: 3876 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (1)..(1): base is a locked nucleic acid
  modified_base (8)..(8): base is a locked nucleic acid
  modified_base (10)..(10): base is a locked nucleic acid
gtagayttyagrgarct

SEQ ID NO: 3877 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (4)..(4): base is a locked nucleic acid
  modified_base (8)..(8): base is a locked nucleic acid
  modified_base (10)..(10): base is a locked nucleic acid
gtagayttyagrgarct

SEQ ID NO: 3878 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (7)..(7): base is a locked nucleic acid
  modified_base (8)..(8): base is a locked nucleic acid
  modified_base (10)..(10): base is a locked nucleic acid
gtagayttyagrgarct

SEQ ID NO: 3879 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
gtagayttyagrgarct

SEQ ID NO: 3880 - DNA, 16 bp, Artificial Sequence
  Oligonucleotide probe
  misc_binding (1)..(16): Hybridization probe for the specific detection of wild-type HIV-1 at codon 77 of the reverse transcriptase gene.
gtagayttyagrgarc

SEQ ID NO: 3881 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (11)..(11): base is a locked nucleic acid
gtagayttyagrgar

SEQ ID NO: 3882 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (12)..(12): base is a locked nucleic acid
gtagayttyagrgar

SEQ ID NO: 3883 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (14)..(14): base is a locked nucleic acid
gtagayttyagrgar

SEQ ID NO: 3884 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (4)..(4): base is a locked nucleic acid
gtagayttyagrgar

SEQ ID NO: 3885 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (2)..(2): base is a locked nucleic acid
gtagayttyagrgar

SEQ ID NO: 3886 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (1)..(1): base is a locked nucleic acid
gtagayttyagrgar

SEQ ID NO: 3887 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (7)..(7): base is a locked nucleic acid
gtagayttyagrgar

SEQ ID NO: 3888 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (12)..(12): base is a locked nucleic acid
gtagayttyagrgar

SEQ ID NO: 3889 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (13)..(13): base is a locked nucleic acid
gtagayttyagrgar

SEQ ID NO: 3890 - DNA, 16 bp, Artificial Sequence
  Oligonucleotide probe
  misc_binding (1)..(16): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
gtagayttyagrgarc

SEQ ID NO: 3891 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (14)..(14): base is a locked nucleic acid
gtagayttyagrgar

SEQ ID NO: 3892 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (6)..(6): base is a locked nucleic acid
  modified_base (8)..(8): base is a locked nucleic acid
  modified_base (10)..(10): base is a locked nucleic acid
gtagayttyagrgar

SEQ ID NO: 3893 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (1)..(1): base is a locked nucleic acid
  modified_base (8)..(8): base is a locked nucleic acid
  modified_base (10)..(10): base is a locked nucleic acid
gtagayttyagrgar

SEQ ID NO: 3894 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (4)..(4): base is a locked nucleic acid
  modified_base (8)..(8): base is a locked nucleic acid
  modified_base (10)..(10): base is a locked nucleic acid
gtagayttyagrgar

SEQ ID NO: 3895 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (7)..(7): base is a locked nucleic acid
  modified_base (8)..(8): base is a locked nucleic acid
  modified_base (10)..(10): base is a locked nucleic acid
gtagayttyagrgar

SEQ ID NO: 3896 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
gtagayttyagrgar

SEQ ID NO: 3897 - DNA, 14 bp, Artificial Sequence
  Oligonucleotide probe
  misc_binding (1)..(14): Hybridization probe for the specific detection of wild-type HIV-1 at codon 77 of the reverse transcriptase gene.
gtagayttyagrga

SEQ ID NO: 3898 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (11)..(11): base is a locked nucleic acid
gtagayttyagrg

SEQ ID NO: 3899 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (12)..(12): base is a locked nucleic acid
gtagayttyagrg

SEQ ID NO: 3900 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
gtagayttyagrg

SEQ ID NO: 3901 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (4)..(4): base is a locked nucleic acid
gtagayttyagrg

SEQ ID NO: 3902 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (2)..(2): base is a locked nucleic acid
gtagayttyagrg

SEQ ID NO: 3903 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (1)..(1): base is a locked nucleic acid
gtagayttyagrg

SEQ ID NO: 3904 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (7)..(7): base is a locked nucleic acid
gtagayttyagrg

SEQ ID NO: 3905 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (12)..(12): base is a locked nucleic acid
gtagayttyagrg

SEQ ID NO: 3906 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
  modified_base (13)..(13): base is a locked nucleic acid
gtagayttyagrg

SEQ ID NO: 3907 - DNA, 14 bp, Artificial Sequence
  Oligonucleotide probe
  misc_binding (1)..(14): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
gtagayttyagrga

SEQ ID NO: 3908 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
gtagayttyagrg

SEQ ID NO: 3909 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (6)..(6): base is a locked nucleic acid
  modified_base (8)..(8): base is a locked nucleic acid
  modified_base (10)..(10): base is a locked nucleic acid
gtagayttyagrg

SEQ ID NO: 3910 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (1)..(1): base is a locked nucleic acid
  modified_base (8)..(8): base is a locked nucleic acid
  modified_base (10)..(10): base is a locked nucleic acid
gtagayttyagrg

SEQ ID NO: 3911 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (4)..(4): base is a locked nucleic acid
  modified_base (8)..(8): base is a locked nucleic acid
  modified_base (10)..(10): base is a locked nucleic acid
gtagayttyagrg

SEQ ID NO: 3912 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (7)..(7): base is a locked nucleic acid
  modified_base (8)..(8): base is a locked nucleic acid
  modified_base (10)..(10): base is a locked nucleic acid
gtagayttyagrg

SEQ ID NO: 3913 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
  modified_base (8)..(8): base is a locked nucleic acid
  modified_base (10)..(10): base is a locked nucleic acid
gtagayttyagrg

SEQ ID NO: 3914 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
ttctctraaatctac

SEQ ID NO: 3915 - DNA, 19 bp, Artificial Sequence
  Oligonucleotide probe
  misc_binding (1)..(19): Hybridization probe for the specific detection of wild-type HIV-1 at codon 77 of the reverse transcriptase gene.
agtagayttyagrgarcty

SEQ ID NO: 3916 - DNA, 17 bp, Artificial Sequence
  Oligonucleotide probe
  misc_binding (1)..(17): Hybridization probe for the specific detection of wild-type HIV-1 at codon 77 of the reverse transcriptase gene.
gtagayttyagrgarct

SEQ ID NO: 3917 - DNA, 15 bp, Artificial Sequence
  Oligonucleotide probe
  misc_binding (1)..(15): Hybridization probe for the specific detection of wild-type HIV-1 at codon 77 of the reverse transcriptase gene.
gtagayttyagrgar

SEQ ID NO: 3918 - DNA, 13 bp, Artificial Sequence
  Oligonucleotide probe
  misc_binding (1)..(13): Hybridization probe for the specific detection of wild-type HIV-1 at codon 77 of the reverse transcriptase gene.
gtagayttyagrg

SEQ ID NO: 3919 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (13)..(13): base is a locked nucleic acid
ttytgggargtycaattag

SEQ ID NO: 3920 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (12)..(12): base is a locked nucleic acid
ttytgggargtycaattag

SEQ ID NO: 3921 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (19)..(19): base is a locked nucleic acid
ttytgggargtycaattag

SEQ ID NO: 3922 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (15)..(15): base is a locked nucleic acid
ttytgggargtycaattag

SEQ ID NO: 3923 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (5)..(5): base is a locked nucleic acid
ttytgggargtycaattag

SEQ ID NO: 3924 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (9)..(9): base is a locked nucleic acid
ttytgggargtycaattag

SEQ ID NO: 3925 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (3)..(3): base is a locked nucleic acid
ttytgggargtycaattag

SEQ ID NO: 3926 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (2)..(2): base is a locked nucleic acid
ttytgggargtycaattag

SEQ ID NO: 3927 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (9)..(9): base is a locked nucleic acid
  modified_base (11)..(11): base is a locked nucleic acid
  modified_base (19)..(19): base is a locked nucleic acid
ttytgggargtycaattag

SEQ ID NO: 3928 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (9)..(9): base is a locked nucleic acid
  modified_base (11)..(11): base is a locked nucleic acid
  modified_base (15)..(15): base is a locked nucleic acid
ttytgggargtycaattag

SEQ ID NO: 3929 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (9)..(9): base is a locked nucleic acid
  modified_base (11)..(11): base is a locked nucleic acid
  modified_base (12)..(12): base is a locked nucleic acid
ttytgggargtycaattag

SEQ ID NO: 3930 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (9)..(9): base is a locked nucleic acid
  modified_base (11)..(11): base is a locked nucleic acid
  modified_base (17)..(17): base is a locked nucleic acid
ttytgggargtycaattag

SEQ ID NO: 3931 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (5)..(5): base is a locked nucleic acid
  modified_base (9)..(9): base is a locked nucleic acid
  modified_base (11)..(11): base is a locked nucleic acid
ttytgggargtycaattag

SEQ ID NO: 3932 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (3)..(3): base is a locked nucleic acid
  modified_base (9)..(9): base is a locked nucleic acid
  modified_base (11)..(11): base is a locked nucleic acid
ttytgggargtycaattag

SEQ ID NO: 3933 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (6)..(6): base is a locked nucleic acid
  modified_base (9)..(9): base is a locked nucleic acid
  modified_base (11)..(11): base is a locked nucleic acid
ttytgggargtycaattag

SEQ ID NO: 3934 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (7)..(7): base is a locked nucleic acid
  modified_base (9)..(9): base is a locked nucleic acid
  modified_base (11)..(11): base is a locked nucleic acid
ttytgggargtycaattag

SEQ ID NO: 3935 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
  modified_base (9)..(9): base is a locked nucleic acid
  modified_base (11)..(11): base is a locked nucleic acid
ttytgggargtycaattag

SEQ ID NO: 3936 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (12)..(12): base is a locked nucleic acid
tytgggargtycaatta

SEQ ID NO: 3937 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (11)..(11): base is a locked nucleic acid
tytgggargtycaatta

SEQ ID NO: 3938 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
tytgggargtycaatta

SEQ ID NO: 3939 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (14)..(14): base is a locked nucleic acid
tytgggargtycaatta

SEQ ID NO: 3940 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (4)..(4): base is a locked nucleic acid
tytgggargtycaatta

SEQ ID NO: 3941 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (8)..(8): base is a locked nucleic acid
tytgggargtycaatta

SEQ ID NO: 3942 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (2)..(2): base is a locked nucleic acid
tytgggargtycaatta

SEQ ID NO: 3943 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (1)..(1): base is a locked nucleic acid
tytgggargtycaatta

SEQ ID NO: 3944 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtycaatta

SEQ ID NO: 3945 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
  modified_base (14)..(14): base is a locked nucleic acid
tytgggargtycaatta

SEQ ID NO: 3946 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
  modified_base (11)..(11): base is a locked nucleic acid
tytgggargtycaatta

SEQ ID NO: 3947 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
  modified_base (16)..(16): base is a locked nucleic acid
tytgggargtycaatta

SEQ ID NO: 3948 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (4)..(4): base is a locked nucleic acid
  modified_base (8)..(8): base is a locked nucleic acid
  modified_base (10)..(10): base is a locked nucleic acid
tytgggargtycaatta

SEQ ID NO: 3949 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (2)..(2): base is a locked nucleic acid
  modified_base (8)..(8): base is a locked nucleic acid
  modified_base (10)..(10): base is a locked nucleic acid
tytgggargtycaatta

SEQ ID NO: 3950 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (5)..(5): base is a locked nucleic acid
  modified_base (8)..(8): base is a locked nucleic acid
  modified_base (10)..(10): base is a locked nucleic acid
tytgggargtycaatta

SEQ ID NO: 3951 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (6)..(6): base is a locked nucleic acid
  modified_base (8)..(8): base is a locked nucleic acid
  modified_base (10)..(10): base is a locked nucleic acid
tytgggargtycaatta

SEQ ID NO: 3952 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtycaatta

SEQ ID NO: 3953 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (12)..(12): base is a locked nucleic acid
tytgggargtycaat

SEQ ID NO: 3954 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (11)..(11): base is a locked nucleic acid
tytgggargtycaat

SEQ ID NO: 3955 - DNA, 16 bp, Artificial Sequence
  Oligonucleotide probe
  misc_binding (1)..(16): Hybridization probe for the specific detection of wild-type HIV-1 at codon 90 of the reverse transcriptase gene.
tytgggargtycaatt

SEQ ID NO: 3956 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (14)..(14): base is a locked nucleic acid
tytgggargtycaat

SEQ ID NO: 3957 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (4)..(4): base is a locked nucleic acid
tytgggargtycaat

SEQ ID NO: 3958 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (8)..(8): base is a locked nucleic acid
tytgggargtycaat

SEQ ID NO: 3959 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (2)..(2): base is a locked nucleic acid
tytgggargtycaat

SEQ ID NO: 3960 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (1)..(1): base is a locked nucleic acid
tytgggargtycaat

SEQ ID NO: 3961 - DNA, 16 bp, Artificial Sequence
  Oligonucleotide probe
  misc_binding (1)..(16): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtycaatt

SEQ ID NO: 3962 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
  modified_base (14)..(14): base is a locked nucleic acid
tytgggargtycaat

SEQ ID NO: 3963 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
  modified_base (11)..(11): base is a locked nucleic acid
tytgggargtycaat

SEQ ID NO: 3964 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtycaat

SEQ ID NO: 3965 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (4)..(4): base is a locked nucleic acid
  modified_base (8)..(8): base is a locked nucleic acid
  modified_base (10)..(10): base is a locked nucleic acid
tytgggargtycaat

SEQ ID NO: 3966 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (2)..(2): base is a locked nucleic acid
  modified_base (8)..(8): base is a locked nucleic acid
  modified_base (10)..(10): base is a locked nucleic acid
tytgggargtycaat

SEQ ID NO: 3967 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (5)..(5): base is a locked nucleic acid
  modified_base (8)..(8): base is a locked nucleic acid
  modified_base (10)..(10): base is a locked nucleic acid
tytgggargtycaat

SEQ ID NO: 3968 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (6)..(6): base is a locked nucleic acid
  modified_base (8)..(8): base is a locked nucleic acid
  modified_base (10)..(10): base is a locked nucleic acid
tytgggargtycaat

SEQ ID NO: 3969 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtycaat

SEQ ID NO: 3970 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (12)..(12): base is a locked nucleic acid
tytgggargtyca

SEQ ID NO: 3971 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (11)..(11): base is a locked nucleic acid
tytgggargtyca

SEQ ID NO: 3972 - DNA, 14 bp, Artificial Sequence
  Oligonucleotide probe
  misc_binding (1)..(14): Hybridization probe for the specific detection of wild-type HIV-1 at codon 90 of the reverse transcriptase gene.
tytgggargtycaa

SEQ ID NO: 3973 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
tytgggargtyca

SEQ ID NO: 3974 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (4)..(4): base is a locked nucleic acid
tytgggargtyca

SEQ ID NO: 3975 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (8)..(8): base is a locked nucleic acid
tytgggargtyca

SEQ ID NO: 3976 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (2)..(2): base is a locked nucleic acid
tytgggargtyca

SEQ ID NO: 3977 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (1)..(1): base is a locked nucleic acid
tytgggargtyca

SEQ ID NO: 3978 - DNA, 14 bp, Artificial Sequence
  Oligonucleotide probe
  misc_binding (1)..(14): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtycaa

SEQ ID NO: 3979 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtyca

SEQ ID NO: 3980 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
  modified_base (11)..(11): base is a locked nucleic acid
tytgggargtyca

SEQ ID NO: 3981 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (4)..(4): base is a locked nucleic acid
  modified_base (8)..(8): base is a locked nucleic acid
  modified_base (10)..(10): base is a locked nucleic acid
tytgggargtyca

SEQ ID NO: 3982 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (2)..(2): base is a locked nucleic acid
  modified_base (8)..(8): base is a locked nucleic acid
  modified_base (10)..(10): base is a locked nucleic acid
tytgggargtyca

SEQ ID NO: 3983 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (5)..(5): base is a locked nucleic acid
  modified_base (8)..(8): base is a locked nucleic acid
  modified_base (10)..(10): base is a locked nucleic acid
tytgggargtyca

SEQ ID NO: 3984 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (6)..(6): base is a locked nucleic acid
  modified_base (8)..(8): base is a locked nucleic acid
  modified_base (10)..(10): base is a locked nucleic acid
tytgggargtyca

SEQ ID NO: 3985 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
  modified_base (8)..(8): base is a locked nucleic acid
  modified_base (10)..(10): base is a locked nucleic acid
tytgggargtyca

SEQ ID NO: 3986 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
  misc_feature (10)..(10): n is a, c, g, or t
ctgggaagtncaatt

SEQ ID NO: 3987 - DNA, 19 bp, Artificial Sequence
  Oligonucleotide probe
  misc_binding (1)..(19): Hybridization probe for the specific detection of wild-type HIV-1 at codon 90 of the reverse transcriptase gene.
ttytgggargtycaattag

SEQ ID NO: 3988 - DNA, 17 bp, Artificial Sequence
  Oligonucleotide probe
  misc_binding (1)..(17): Hybridization probe for the specific detection of wild-type HIV-1 at codon 90 of the reverse transcriptase gene.
tytgggargtycaatta

SEQ ID NO: 3989 - DNA, 15 bp, Artificial Sequence
  Oligonucleotide probe
  misc_binding (1)..(15): Hybridization probe for the specific detection of wild-type HIV-1 at codon 90 of the reverse transcriptase gene.
tytgggargtycaat

SEQ ID NO: 3990 - DNA, 13 bp, Artificial Sequence
  Oligonucleotide probe
  misc_binding (1)..(13): Hybridization probe for the specific detection of wild-type HIV-1 at codon 90 of the reverse transcriptase gene.
tytgggargtyca

SEQ ID NO: 3991 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (13)..(13): base is a locked nucleic acid
cncaycchgcrggdytaaa

SEQ ID NO: 3992 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (15)..(15): base is a locked nucleic acid
cncaycchgcrggdytaaa

SEQ ID NO: 3993 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (17)..(17): base is a locked nucleic acid
cncaycchgcrggdytaaa

SEQ ID NO: 3994 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (19)..(19): base is a locked nucleic acid
cncaycchgcrggdytaaa

SEQ ID NO: 3995 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (3)..(3): base is a locked nucleic acid
cncaycchgcrggdytaaa

SEQ ID NO: 3996 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (4)..(4): base is a locked nucleic acid
cncaycchgcrggdytaaa

SEQ ID NO: 3997 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (5)..(5): base is a locked nucleic acid
cncaycchgcrggdytaaa

SEQ ID NO: 3998 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  modified_base (2)..(2): base is a locked nucleic acid
  misc_feature (2)..(2): n is a, c, g, or t
cncaycchgcrggdytaaa

SEQ ID NO: 3999 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (9)..(9): base is a locked nucleic acid
  modified_base (11)..(11): base is a locked nucleic acid
  modified_base (13)..(13): base is a locked nucleic acid
cncaycchgcrggdytaaa

SEQ ID NO: 4000 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (9)..(9): base is a locked nucleic acid
  modified_base (11)..(11): base is a locked nucleic acid
  modified_base (15)..(15): base is a locked nucleic acid
cncaycchgcrggdytaaa

SEQ ID NO: 4001 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (9)..(9): base is a locked nucleic acid
  modified_base (11)..(11): base is a locked nucleic acid
  modified_base (12)..(12): base is a locked nucleic acid
cncaycchgcrggdytaaa

SEQ ID NO: 4002 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (9)..(9): base is a locked nucleic acid
  modified_base (11)..(11): base is a locked nucleic acid
  modified_base (19)..(19): base is a locked nucleic acid
cncaycchgcrggdytaaa

SEQ ID NO: 4003 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (6)..(6): base is a locked nucleic acid
  modified_base (9)..(9): base is a locked nucleic acid
  modified_base (11)..(11): base is a locked nucleic acid
cncaycchgcrggdytaaa

SEQ ID NO: 4004 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (8)..(8): base is a locked nucleic acid
  modified_base (9)..(9): base is a locked nucleic acid
  modified_base (11)..(11): base is a locked nucleic acid
cncaycchgcrggdytaaa

SEQ ID NO: 4005 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (3)..(3): base is a locked nucleic acid
  modified_base (9)..(9): base is a locked nucleic acid
  modified_base (11)..(11): base is a locked nucleic acid
cncaycchgcrggdytaaa

SEQ ID NO: 4006 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (7)..(7): base is a locked nucleic acid
  modified_base (9)..(9): base is a locked nucleic acid
  modified_base (11)..(11): base is a locked nucleic acid
cncaycchgcrggdytaaa

SEQ ID NO: 4007 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
  modified_base (9)..(9): base is a locked nucleic acid
  modified_base (11)..(11): base is a locked nucleic acid
cncaycchgcrggdytaaa

SEQ ID NO: 4008 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (12)..(12): base is a locked nucleic acid
ncaycchgcrggdytaa

SEQ ID NO: 4009 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (14)..(14): base is a locked nucleic acid
ncaycchgcrggdytaa

SEQ ID NO: 4010 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (16)..(16): base is a locked nucleic acid
ncaycchgcrggdytaa

SEQ ID NO: 4011 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
ncaycchgcrggdytaa

SEQ ID NO: 4012 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (2)..(2): base is a locked nucleic acid
ncaycchgcrggdytaa

SEQ ID NO: 4013 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (3)..(3): base is a locked nucleic acid
ncaycchgcrggdytaa

SEQ ID NO: 4014 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (4)..(4): base is a locked nucleic acid
ncaycchgcrggdytaa

SEQ ID NO: 4015 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  modified_base (1)..(1): base is a locked nucleic acid
  misc_feature (1)..(1): n is a, c, g, or t
ncaycchgcrggdytaa

SEQ ID NO: 4016 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (12)..(12): base is a locked nucleic acid
ncaycchgcrggdytaa

SEQ ID NO: 4017 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (14)..(14): base is a locked nucleic acid
ncaycchgcrggdytaa

SEQ ID NO: 4018 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (11)..(11): base is a locked nucleic acid
ncaycchgcrggdytaa

SEQ ID NO: 4019 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
ncaycchgcrggdytaa

SEQ ID NO: 4020 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (5)..(5): base is a locked nucleic acid
  modified_base (8)..(8): base is a locked nucleic acid
  modified_base (10)..(10): base is a locked nucleic acid
ncaycchgcrggdytaa

SEQ ID NO: 4021 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (7)..(7): base is a locked nucleic acid
  modified_base (8)..(8): base is a locked nucleic acid
  modified_base (10)..(10): base is a locked nucleic acid
ncaycchgcrggdytaa

SEQ ID NO: 4022 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (2)..(2): base is a locked nucleic acid
  modified_base (8)..(8): base is a locked nucleic acid
  modified_base (10)..(10): base is a locked nucleic acid
ncaycchgcrggdytaa

SEQ ID NO: 4023 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (6)..(6): base is a locked nucleic acid
  modified_base (8)..(8): base is a locked nucleic acid
  modified_base (10)..(10): base is a locked nucleic acid
ncaycchgcrggdytaa

SEQ ID NO: 4024 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
ncaycchgcrggdytaa

SEQ ID NO: 4025 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (12)..(12): base is a locked nucleic acid
ncaycchgcrggdyt

SEQ ID NO: 4026 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (14)..(14): base is a locked nucleic acid
ncaycchgcrggdyt

SEQ ID NO: 4027 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
ncaycchgcrggdyt

SEQ ID NO: 4028 - DNA, 16 bp, Artificial Sequence
  Oligonucleotide probe
  misc_binding (1)..(16): Hybridization probe for the specific detection of wild-type HIV-1 at codon 98 of the reverse transcriptase gene.
  misc_feature (1)..(1): n is a, c, g, or t
ncaycchgcrggdyta

SEQ ID NO: 4029 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (2)..(2): base is a locked nucleic acid
ncaycchgcrggdyt

SEQ ID NO: 4030 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (3)..(3): base is a locked nucleic acid
ncaycchgcrggdyt

SEQ ID NO: 4031 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (4)..(4): base is a locked nucleic acid
ncaycchgcrggdyt

SEQ ID NO: 4032 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  modified_base (1)..(1): base is a locked nucleic acid
  misc_feature (1)..(1): n is a, c, g, or t
ncaycchgcrggdyt

SEQ ID NO: 4033 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (12)..(12): base is a locked nucleic acid
ncaycchgcrggdyt

SEQ ID NO: 4034 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (14)..(14): base is a locked nucleic acid
ncaycchgcrggdyt

SEQ ID NO: 4035 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (11)..(11): base is a locked nucleic acid
ncaycchgcrggdyt

SEQ ID NO: 4036 - DNA, 16 bp, Artificial Sequence
  Oligonucleotide probe
  misc_binding (1)..(16): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
ncaycchgcrggdyta

SEQ ID NO: 4037 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (5)..(5): base is a locked nucleic acid
  modified_base (8)..(8): base is a locked nucleic acid
  modified_base (10)..(10): base is a locked nucleic acid
ncaycchgcrggdyt

SEQ ID NO: 4038 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (7)..(7): base is a locked nucleic acid
  modified_base (8)..(8): base is a locked nucleic acid
  modified_base (10)..(10): base is a locked nucleic acid
ncaycchgcrggdyt

SEQ ID NO: 4039 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (2)..(2): base is a locked nucleic acid
  modified_base (8)..(8): base is a locked nucleic acid
  modified_base (10)..(10): base is a locked nucleic acid
ncaycchgcrggdyt

SEQ ID NO: 4040 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (6)..(6): base is a locked nucleic acid
  modified_base (8)..(8): base is a locked nucleic acid
  modified_base (10)..(10): base is a locked nucleic acid
ncaycchgcrggdyt

SEQ ID NO: 4041 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
ncaycchgcrggdyt

SEQ ID NO: 4042 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (12)..(12): base is a locked nucleic acid
ncaycchgcrggd

SEQ ID NO: 4043 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
ncaycchgcrggd

SEQ ID NO: 4044 - DNA, 14 bp, Artificial Sequence
  Oligonucleotide probe
  misc_binding (1)..(14): Hybridization probe for the specific detection of wild-type HIV-1 at codon 98 of the reverse transcriptase gene.
  misc_feature (1)..(1): n is a, c, g, or t
ncaycchgcrggdy

SEQ ID NO: 4045 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (2)..(2): base is a locked nucleic acid
ncaycchgcrggd

SEQ ID NO: 4046 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (3)..(3): base is a locked nucleic acid
ncaycchgcrggd

SEQ ID NO: 4047 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (4)..(4): base is a locked nucleic acid
ncaycchgcrggd

SEQ ID NO: 4048 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  modified_base (1)..(1): base is a locked nucleic acid
  misc_feature (1)..(1): n is a, c, g, or t
ncaycchgcrggd

SEQ ID NO: 4049 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (12)..(12): base is a locked nucleic acid
ncaycchgcrggd

SEQ ID NO: 4050 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
ncaycchgcrggd

SEQ ID NO: 4051 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
  modified_base (11)..(11): base is a locked nucleic acid
ncaycchgcrggd

SEQ ID NO: 4052 - DNA, 14 bp, Artificial Sequence
  Oligonucleotide probe
  misc_binding (1)..(14): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
ncaycchgcrggdy

SEQ ID NO: 4053 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (5)..(5): base is a locked nucleic acid
  modified_base (8)..(8): base is a locked nucleic acid
  modified_base (10)..(10): base is a locked nucleic acid
ncaycchgcrggd

SEQ ID NO: 4054 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (7)..(7): base is a locked nucleic acid
  modified_base (8)..(8): base is a locked nucleic acid
  modified_base (10)..(10): base is a locked nucleic acid
ncaycchgcrggd

SEQ ID NO: 4055 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (2)..(2): base is a locked nucleic acid
  modified_base (8)..(8): base is a locked nucleic acid
  modified_base (10)..(10): base is a locked nucleic acid
ncaycchgcrggd

SEQ ID NO: 4056 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (6)..(6): base is a locked nucleic acid
  modified_base (8)..(8): base is a locked nucleic acid
  modified_base (10)..(10): base is a locked nucleic acid
ncaycchgcrggd

SEQ ID NO: 4057 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
  modified_base (8)..(8): base is a locked nucleic acid
  modified_base (10)..(10): base is a locked nucleic acid
ncaycchgcrggd

SEQ ID NO: 4058 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
catccagchgggtta

SEQ ID NO: 4059 - DNA, 19 bp, Artificial Sequence
  Oligonucleotide probe
  misc_binding (1)..(19): Hybridization probe for the specific detection of wild-type HIV-1 at codon 98 of the reverse transcriptase gene.
  misc_feature (2)..(2): n is a, c, g, or t
cncaycchgcrggdytaaa

SEQ ID NO: 4060 - DNA, 17 bp, Artificial Sequence
  Oligonucleotide probe
  misc_binding (1)..(17): Hybridization probe for the specific detection of wild-type HIV-1 at codon 98 of the reverse transcriptase gene.
  misc_feature (1)..(1): n is a, c, g, or t
ncaycchgcrggdytaa

SEQ ID NO: 4061 - DNA, 15 bp, Artificial Sequence
  Oligonucleotide probe
  misc_binding (1)..(15): Hybridization probe for the specific detection of wild-type HIV-1 at codon 98 of the reverse transcriptase gene.
  misc_feature (1)..(1): n is a, c, g, or t
ncaycchgcrggdyt

SEQ ID NO: 4062 - DNA, 13 bp, Artificial Sequence
  Oligonucleotide probe
  misc_binding (1)..(13): Hybridization probe for the specific detection of wild-type HIV-1 at codon 98 of the reverse transcriptase gene.
  misc_feature (1)..(1): n is a, c, g, or t
ncaycchgcrggd

SEQ ID NO: 4063 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (16)..(16): base is a locked nucleic acid
cchgcrggdytaaaaaaga

SEQ ID NO: 4064 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (14)..(14): base is a locked nucleic acid
cchgcrggdytaaaaaaga

SEQ ID NO: 4065 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (15)..(15): base is a locked nucleic acid
cchgcrggdytaaaaaaga

SEQ ID NO: 4066 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (19)..(19): base is a locked nucleic acid
cchgcrggdytaaaaaaga

SEQ ID NO: 4067 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (4)..(4): base is a locked nucleic acid
cchgcrggdytaaaaaaga

SEQ ID NO: 4068 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (9)..(9): base is a locked nucleic acid
cchgcrggdytaaaaaaga

SEQ ID NO: 4069 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (3)..(3): base is a locked nucleic acid
cchgcrggdytaaaaaaga

SEQ ID NO: 4070 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (2)..(2): base is a locked nucleic acid
cchgcrggdytaaaaaaga

SEQ ID NO: 4071 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (9)..(9): base is a locked nucleic acid
  modified_base (11)..(11): base is a locked nucleic acid
  modified_base (19)..(19): base is a locked nucleic acid
cchgcrggdytaaaaaaga

SEQ ID NO: 4072 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (9)..(9): base is a locked nucleic acid
  modified_base (11)..(11): base is a locked nucleic acid
  modified_base (15)..(15): base is a locked nucleic acid
cchgcrggdytaaaaaaga

SEQ ID NO: 4073 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (9)..(9): base is a locked nucleic acid
  modified_base (11)..(11): base is a locked nucleic acid
  modified_base (12)..(12): base is a locked nucleic acid
cchgcrggdytaaaaaaga

SEQ ID NO: 4074 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (9)..(9): base is a locked nucleic acid
  modified_base (11)..(11): base is a locked nucleic acid
  modified_base (16)..(16): base is a locked nucleic acid
cchgcrggdytaaaaaaga

SEQ ID NO: 4075 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (6)..(6): base is a locked nucleic acid
  modified_base (9)..(9): base is a locked nucleic acid
  modified_base (11)..(11): base is a locked nucleic acid
cchgcrggdytaaaaaaga

SEQ ID NO: 4076 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (8)..(8): base is a locked nucleic acid
  modified_base (9)..(9): base is a locked nucleic acid
  modified_base (11)..(11): base is a locked nucleic acid
cchgcrggdytaaaaaaga

SEQ ID NO: 4077 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (4)..(4): base is a locked nucleic acid
  modified_base (9)..(9): base is a locked nucleic acid
  modified_base (11)..(11): base is a locked nucleic acid
cchgcrggdytaaaaaaga

SEQ ID NO: 4078 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (3)..(3): base is a locked nucleic acid
  modified_base (9)..(9): base is a locked nucleic acid
  modified_base (11)..(11): base is a locked nucleic acid
cchgcrggdytaaaaaaga

SEQ ID NO: 4079 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
  modified_base (9)..(9): base is a locked nucleic acid
  modified_base (11)..(11): base is a locked nucleic acid
cchgcrggdytaaaaaaga

SEQ ID NO: 4080 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (15)..(15): base is a locked nucleic acid
chgcrggdytaaaaaag

SEQ ID NO: 4081 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (13)..(13): base is a locked nucleic acid
chgcrggdytaaaaaag

SEQ ID NO: 4082 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (14)..(14): base is a locked nucleic acid
chgcrggdytaaaaaag

SEQ ID NO: 4083 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
chgcrggdytaaaaaag

SEQ ID NO: 4084 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (3)..(3): base is a locked nucleic acid
chgcrggdytaaaaaag

SEQ ID NO: 4085 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (8)..(8): base is a locked nucleic acid
chgcrggdytaaaaaag

SEQ ID NO: 4086 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (2)..(2): base is a locked nucleic acid
chgcrggdytaaaaaag

SEQ ID NO: 4087 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (1)..(1): base is a locked nucleic acid
chgcrggdytaaaaaag

SEQ ID NO: 4088 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
chgcrggdytaaaaaag

SEQ ID NO: 4089 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
  modified_base (14)..(14): base is a locked nucleic acid
chgcrggdytaaaaaag

SEQ ID NO: 4090 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
  modified_base (11)..(11): base is a locked nucleic acid
chgcrggdytaaaaaag

SEQ ID NO: 4091 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
  modified_base (15)..(15): base is a locked nucleic acid
chgcrggdytaaaaaag

SEQ ID NO: 4092 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (5)..(5): base is a locked nucleic acid
  modified_base (8)..(8): base is a locked nucleic acid
  modified_base (10)..(10): base is a locked nucleic acid
chgcrggdytaaaaaag

SEQ ID NO: 4093 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (7)..(7): base is a locked nucleic acid
  modified_base (8)..(8): base is a locked nucleic acid
  modified_base (10)..(10): base is a locked nucleic acid
chgcrggdytaaaaaag

SEQ ID NO: 4094 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (3)..(3): base is a locked nucleic acid
  modified_base (8)..(8): base is a locked nucleic acid
  modified_base (10)..(10): base is a locked nucleic acid
chgcrggdytaaaaaag

SEQ ID NO: 4095 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (2)..(2): base is a locked nucleic acid
  modified_base (8)..(8): base is a locked nucleic acid
  modified_base (10)..(10): base is a locked nucleic acid
chgcrggdytaaaaaag

SEQ ID NO: 4096 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
chgcrggdytaaaaaag

SEQ ID NO: 4097 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (15)..(15): base is a locked nucleic acid
chgcrggdytaaaaa

SEQ ID NO: 4098 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (13)..(13): base is a locked nucleic acid
chgcrggdytaaaaa

SEQ ID NO: 4099 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (14)..(14): base is a locked nucleic acid
chgcrggdytaaaaa

SEQ ID NO: 4100 - DNA, 16 bp, Artificial Sequence
  Oligonucleotide probe
  misc_binding (1)..(16): Hybridization probe for the specific detection of wild-type HIV-1 at codon 100 of the reverse transcriptase gene.
chgcrggdytaaaaaa

SEQ ID NO: 4101 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (3)..(3): base is a locked nucleic acid
chgcrggdytaaaaa

SEQ ID NO: 4102 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (8)..(8): base is a locked nucleic acid
chgcrggdytaaaaa

SEQ ID NO: 4103 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (2)..(2): base is a locked nucleic acid
chgcrggdytaaaaa

SEQ ID NO: 4104 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (1)..(1): base is a locked nucleic acid
chgcrggdytaaaaa

SEQ ID NO: 4105 - DNA, 16 bp, Artificial Sequence
  Oligonucleotide probe
  misc_binding (1)..(16): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
chgcrggdytaaaaaa

SEQ ID NO: 4106 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
  modified_base (14)..(14): base is a locked nucleic acid
chgcrggdytaaaaa

SEQ ID NO: 4107 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
  modified_base (11)..(11): base is a locked nucleic acid
chgcrggdytaaaaa

SEQ ID NO: 4108 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
  modified_base (15)..(15): base is a locked nucleic acid
chgcrggdytaaaaa

SEQ ID NO: 4109 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (5)..(5): base is a locked nucleic acid
  modified_base (8)..(8): base is a locked nucleic acid
  modified_base (10)..(10): base is a locked nucleic acid
chgcrggdytaaaaa

SEQ ID NO: 4110 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (7)..(7): base is a locked nucleic acid
  modified_base (8)..(8): base is a locked nucleic acid
  modified_base (10)..(10): base is a locked nucleic acid
chgcrggdytaaaaa

SEQ ID NO: 4111 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (3)..(3): base is a locked nucleic acid
  modified_base (8)..(8): base is a locked nucleic acid
  modified_base (10)..(10): base is a locked nucleic acid
chgcrggdytaaaaa

SEQ ID NO: 4112 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (2)..(2): base is a locked nucleic acid
  modified_base (8)..(8): base is a locked nucleic acid
  modified_base (10)..(10): base is a locked nucleic acid
chgcrggdytaaaaa

SEQ ID NO: 4113 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
chgcrggdytaaaaa

SEQ ID NO: 4114 - DNA, 14 bp, Artificial Sequence
  Oligonucleotide probe
  misc_binding (1)..(14): Hybridization probe for the specific detection of wild-type HIV-1 at codon 100 of the reverse transcriptase gene.
chgcrggdytaaaa

SEQ ID NO: 4115 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (13)..(13): base is a locked nucleic acid
chgcrggdytaaa

SEQ ID NO: 4116 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
chgcrggdytaaa

SEQ ID NO: 4117 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (3)..(3): base is a locked nucleic acid
chgcrggdytaaa

SEQ ID NO: 4118 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (8)..(8): base is a locked nucleic acid
chgcrggdytaaa

SEQ ID NO: 4119 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (2)..(2): base is a locked nucleic acid
chgcrggdytaaa

SEQ ID NO: 4120 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (1)..(1): base is a locked nucleic acid
chgcrggdytaaa

SEQ ID NO: 4121 - DNA, 14 bp, Artificial Sequence
  Oligonucleotide probe
  misc_binding (1)..(14): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
chgcrggdytaaaa

SEQ ID NO: 4122 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
chgcrggdytaaa

SEQ ID NO: 4123 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
  modified_base (11)..(11): base is a locked nucleic acid
chgcrggdytaaa

SEQ ID NO: 4124 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (5)..(5): base is a locked nucleic acid
  modified_base (8)..(8): base is a locked nucleic acid
  modified_base (10)..(10): base is a locked nucleic acid
chgcrggdytaaa

SEQ ID NO: 4125 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (7)..(7): base is a locked nucleic acid
  modified_base (8)..(8): base is a locked nucleic acid
  modified_base (10)..(10): base is a locked nucleic acid
chgcrggdytaaa

SEQ ID NO: 4126 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (3)..(3): base is a locked nucleic acid
  modified_base (8)..(8): base is a locked nucleic acid
  modified_base (10)..(10): base is a locked nucleic acid
chgcrggdytaaa

SEQ ID NO: 4127 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (2)..(2): base is a locked nucleic acid
  modified_base (8)..(8): base is a locked nucleic acid
  modified_base (10)..(10): base is a locked nucleic acid
chgcrggdytaaa

SEQ ID NO: 4128 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
  modified_base (8)..(8): base is a locked nucleic acid
  modified_base (10)..(10): base is a locked nucleic acid
chgcrggdytaaa

SEQ ID NO: 4129 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
agcagggytraaaaa

SEQ ID NO: 4130 - DNA, 19 bp, Artificial Sequence
  Oligonucleotide probe
  misc_binding (1)..(19): Hybridization probe for the specific detection of wild-type HIV-1 at codon 100 of the reverse transcriptase gene.
cchgcrggdytaaaaaaga

SEQ ID NO: 4131 - DNA, 17 bp, Artificial Sequence
  Oligonucleotide probe
  misc_binding (1)..(17): Hybridization probe for the specific detection of wild-type HIV-1 at codon 100 of the reverse transcriptase gene.
chgcrggdytaaaaaag

SEQ ID NO: 4132 - DNA, 15 bp, Artificial Sequence
  Oligonucleotide probe
  misc_binding (1)..(15): Hybridization probe for the specific detection of wild-type HIV-1 at codon 100 of the reverse transcriptase gene.
chgcrggdytaaaaa

SEQ ID NO: 4133 - DNA, 13 bp, Artificial Sequence
  Oligonucleotide probe
  misc_binding (1)..(13): Hybridization probe for the specific detection of wild-type HIV-1 at codon 100 of the reverse transcriptase gene.
chgcrggdytaaa

SEQ ID NO: 4134 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (15)..(15): base is a locked nucleic acid
gcrggdytaaaaaagaama

SEQ ID NO: 4135 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (12)..(12): base is a locked nucleic acid
gcrggdytaaaaaagaama

SEQ ID NO: 4136 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (17)..(17): base is a locked nucleic acid
gcrggdytaaaaaagaama

SEQ ID NO: 4137 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (16)..(16): base is a locked nucleic acid
gcrggdytaaaaaagaama

SEQ ID NO: 4138 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (9)..(9): base is a locked nucleic acid
gcrggdytaaaaaagaama

SEQ ID NO: 4139 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (6)..(6): base is a locked nucleic acid
gcrggdytaaaaaagaama

SEQ ID NO: 4140 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (3)..(3): base is a locked nucleic acid
gcrggdytaaaaaagaama

SEQ ID NO: 4141 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (5)..(5): base is a locked nucleic acid
gcrggdytaaaaaagaama

SEQ ID NO: 4142 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (9)..(9): base is a locked nucleic acid
  modified_base (11)..(11): base is a locked nucleic acid
  modified_base (12)..(12): base is a locked nucleic acid
gcrggdytaaaaaagaama

SEQ ID NO: 4143 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (9)..(9): base is a locked nucleic acid
  modified_base (11)..(11): base is a locked nucleic acid
  modified_base (19)..(19): base is a locked nucleic acid
gcrggdytaaaaaagaama

SEQ ID NO: 4144 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (9)..(9): base is a locked nucleic acid
  modified_base (11)..(11): base is a locked nucleic acid
  modified_base (14)..(14): base is a locked nucleic acid
gcrggdytaaaaaagaama

SEQ ID NO: 4145 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (9)..(9): base is a locked nucleic acid
  modified_base (11)..(11): base is a locked nucleic acid
  modified_base (18)..(18): base is a locked nucleic acid
gcrggdytaaaaaagaama

SEQ ID NO: 4146 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (6)..(6): base is a locked nucleic acid
  modified_base (9)..(9): base is a locked nucleic acid
  modified_base (11)..(11): base is a locked nucleic acid
gcrggdytaaaaaagaama

SEQ ID NO: 4147 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (2)..(2): base is a locked nucleic acid
  modified_base (9)..(9): base is a locked nucleic acid
  modified_base (11)..(11): base is a locked nucleic acid
gcrggdytaaaaaagaama

SEQ ID NO: 4148 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (7)..(7): base is a locked nucleic acid
  modified_base (9)..(9): base is a locked nucleic acid
  modified_base (11)..(11): base is a locked nucleic acid
gcrggdytaaaaaagaama

SEQ ID NO: 4149 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (3)..(3): base is a locked nucleic acid
  modified_base (9)..(9): base is a locked nucleic acid
  modified_base (11)..(11): base is a locked nucleic acid
gcrggdytaaaaaagaama

SEQ ID NO: 4150 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
  modified_base (9)..(9): base is a locked nucleic acid
  modified_base (11)..(11): base is a locked nucleic acid
gcrggdytaaaaaagaama

SEQ ID NO: 4151 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (14)..(14): base is a locked nucleic acid
crggdytaaaaaagaam

SEQ ID NO: 4152 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (11)..(11): base is a locked nucleic acid
crggdytaaaaaagaam

SEQ ID NO: 4153 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (16)..(16): base is a locked nucleic acid
crggdytaaaaaagaam

SEQ ID NO: 4154 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (15)..(15): base is a locked nucleic acid
crggdytaaaaaagaam

SEQ ID NO: 4155 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (8)..(8): base is a locked nucleic acid
crggdytaaaaaagaam

SEQ ID NO: 4156 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (5)..(5): base is a locked nucleic acid
crggdytaaaaaagaam

SEQ ID NO: 4157 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (2)..(2): base is a locked nucleic acid
crggdytaaaaaagaam

SEQ ID NO: 4158 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (4)..(4): base is a locked nucleic acid
crggdytaaaaaagaam

SEQ ID NO: 4159 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
  modified_base (11)..(11): base is a locked nucleic acid
crggdytaaaaaagaam

SEQ ID NO: 4160 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
crggdytaaaaaagaam

SEQ ID NO: 4161 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
  modified_base (13)..(13): base is a locked nucleic acid
crggdytaaaaaagaam

SEQ ID NO: 4162 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
  modified_base (17)..(17): base is a locked nucleic acid
crggdytaaaaaagaam

SEQ ID NO: 4163 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (5)..(5): base is a locked nucleic acid
  modified_base (8)..(8): base is a locked nucleic acid
  modified_base (10)..(10): base is a locked nucleic acid
crggdytaaaaaagaam

SEQ ID NO: 4164 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (1)..(1): base is a locked nucleic acid
  modified_base (8)..(8): base is a locked nucleic acid
  modified_base (10)..(10): base is a locked nucleic acid
crggdytaaaaaagaam

SEQ ID NO: 4165 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (6)..(6): base is a locked nucleic acid
  modified_base (8)..(8): base is a locked nucleic acid
  modified_base (10)..(10): base is a locked nucleic acid
crggdytaaaaaagaam

SEQ ID NO: 4166 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (2)..(2): base is a locked nucleic acid
  modified_base (8)..(8): base is a locked nucleic acid
  modified_base (10)..(10): base is a locked nucleic acid
crggdytaaaaaagaam

SEQ ID NO: 4167 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
crggdytaaaaaagaam

SEQ ID NO: 4168 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (14)..(14): base is a locked nucleic acid
crggdytaaaaaaga

SEQ ID NO: 4169 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (11)..(11): base is a locked nucleic acid
crggdytaaaaaaga

SEQ ID NO: 4170 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
crggdytaaaaaaga

SEQ ID NO: 4171 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (15)..(15): base is a locked nucleic acid
crggdytaaaaaaga

SEQ ID NO: 4172 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (8)..(8): base is a locked nucleic acid
crggdytaaaaaaga

SEQ ID NO: 4173 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (5)..(5): base is a locked nucleic acid
crggdytaaaaaaga

SEQ ID NO: 4174 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (2)..(2): base is a locked nucleic acid
crggdytaaaaaaga

SEQ ID NO: 4175 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (4)..(4): base is a locked nucleic acid
crggdytaaaaaaga

SEQ ID NO: 4176 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
  modified_base (11)..(11): base is a locked nucleic acid
crggdytaaaaaaga

SEQ ID NO: 4177 - DNA, 16 bp, Artificial Sequence
  Oligonucleotide probe
  misc_binding (1)..(16): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
crggdytaaaaaagaa

SEQ ID NO: 4178 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
  modified_base (13)..(13): base is a locked nucleic acid
crggdytaaaaaaga

SEQ ID NO: 4179 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (5)..(5): base is a locked nucleic acid
  modified_base (8)..(8): base is a locked nucleic acid
  modified_base (10)..(10): base is a locked nucleic acid
crggdytaaaaaaga

SEQ ID NO: 4180 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (1)..(1): base is a locked nucleic acid
  modified_base (8)..(8): base is a locked nucleic acid
  modified_base (10)..(10): base is a locked nucleic acid
crggdytaaaaaaga

SEQ ID NO: 4181 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (6)..(6): base is a locked nucleic acid
  modified_base (8)..(8): base is a locked nucleic acid
  modified_base (10)..(10): base is a locked nucleic acid
crggdytaaaaaaga

SEQ ID NO: 4182 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (2)..(2): base is a locked nucleic acid
  modified_base (8)..(8): base is a locked nucleic acid
  modified_base (10)..(10): base is a locked nucleic acid
crggdytaaaaaaga

SEQ ID NO: 4183 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
crggdytaaaaaaga

SEQ ID NO: 4184 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
crggdytaaaaaa

SEQ ID NO: 4185 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (11)..(11): base is a locked nucleic acid
crggdytaaaaaa

SEQ ID NO: 4186 - DNA, 14 bp, Artificial Sequence
  Oligonucleotide probe
  misc_binding (1)..(14): Hybridization probe for the specific detection of wild-type HIV-1 at codon 101 of the reverse transcriptase gene.
crggdytaaaaaag

SEQ ID NO: 4187 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (8)..(8): base is a locked nucleic acid
crggdytaaaaaa

SEQ ID NO: 4188 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (5)..(5): base is a locked nucleic acid
crggdytaaaaaa

SEQ ID NO: 4189 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (2)..(2): base is a locked nucleic acid
crggdytaaaaaa

SEQ ID NO: 4190 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (4)..(4): base is a locked nucleic acid
crggdytaaaaaa

SEQ ID NO: 4191 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
  modified_base (11)..(11): base is a locked nucleic acid
crggdytaaaaaa

SEQ ID NO: 4192 - DNA, 14 bp, Artificial Sequence
  Oligonucleotide probe
  misc_binding (1)..(14): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
crggdytaaaaaag

SEQ ID NO: 4193 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
  modified_base (13)..(13): base is a locked nucleic acid
crggdytaaaaaa

SEQ ID NO: 4194 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (5)..(5): base is a locked nucleic acid
  modified_base (8)..(8): base is a locked nucleic acid
  modified_base (10)..(10): base is a locked nucleic acid
crggdytaaaaaa

SEQ ID NO: 4195 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (1)..(1): base is a locked nucleic acid
  modified_base (8)..(8): base is a locked nucleic acid
  modified_base (10)..(10): base is a locked nucleic acid
crggdytaaaaaa

SEQ ID NO: 4196 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (6)..(6): base is a locked nucleic acid
  modified_base (8)..(8): base is a locked nucleic acid
  modified_base (10)..(10): base is a locked nucleic acid
crggdytaaaaaa

SEQ ID NO: 4197 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (2)..(2): base is a locked nucleic acid
  modified_base (8)..(8): base is a locked nucleic acid
  modified_base (10)..(10): base is a locked nucleic acid
crggdytaaaaaa

SEQ ID NO: 4198 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
  modified_base (8)..(8): base is a locked nucleic acid
  modified_base (10)..(10): base is a locked nucleic acid
crggdytaaaaaa

SEQ ID NO: 4199 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
tttcttytttaaccc

SEQ ID NO: 4200 - DNA, 19 bp, Artificial Sequence
  Oligonucleotide probe
  misc_binding (1)..(19): Hybridization probe for the specific detection of wild-type HIV-1 at codon 101 of the reverse transcriptase gene.
gcrggdytaaaaaagaama

SEQ ID NO: 4201 - DNA, 17 bp, Artificial Sequence
  Oligonucleotide probe
  misc_binding (1)..(17): Hybridization probe for the specific detection of wild-type HIV-1 at codon 101 of the reverse transcriptase gene.
crggdytaaaaaagaam

SEQ ID NO: 4202 - DNA, 15 bp, Artificial Sequence
  Oligonucleotide probe
  misc_binding (1)..(15): Hybridization probe for the specific detection of wild-type HIV-1 at codon 101 of the reverse transcriptase gene.
crggdytaaaaaaga

SEQ ID NO: 4203 - DNA, 16 bp, Artificial Sequence
  Oligonucleotide probe
  misc_binding (1)..(16): Hybridization probe for the specific detection of wild-type HIV-1 at codon 101 of the reverse transcriptase gene.
crggdytaaaaaagaa

SEQ ID NO: 4204 - DNA, 13 bp, Artificial Sequence
  Oligonucleotide probe
  misc_binding (1)..(13): Hybridization probe for the specific detection of wild-type HIV-1 at codon 101 of the reverse transcriptase gene.
crggdytaaaaaa

SEQ ID NO: 4205 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (15)..(15): base is a locked nucleic acid
aaaaaagaaraaatcagtr

SEQ ID NO: 4206 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (16)..(16): base is a locked nucleic acid
aaaaaagaaraaatcagtr

SEQ ID NO: 4207 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (11)..(11): base is a locked nucleic acid
aaaaaagaaraaatcagtr

SEQ ID NO: 4208 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (17)..(17): base is a locked nucleic acid
aaaaaagaaraaatcagtr

SEQ ID NO: 4209 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (4)..(4): base is a locked nucleic acid
aaaaaagaaraaatcagtr

SEQ ID NO: 4210 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (5)..(5): base is a locked nucleic acid
aaaaaagaaraaatcagtr

SEQ ID NO: 4211 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (8)..(8): base is a locked nucleic acid
aaaaaagaaraaatcagtr

SEQ ID NO: 4212 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (6)..(6): base is a locked nucleic acid
aaaaaagaaraaatcagtr

SEQ ID NO: 4213 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (9)..(9): base is a locked nucleic acid
  modified_base (11)..(11): base is a locked nucleic acid
  modified_base (17)..(17): base is a locked nucleic acid
aaaaaagaaraaatcagtr

SEQ ID NO: 4214 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (9)..(9): base is a locked nucleic acid
  modified_base (11)..(11): base is a locked nucleic acid
  modified_base (15)..(15): base is a locked nucleic acid
aaaaaagaaraaatcagtr

SEQ ID NO: 4215 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (9)..(9): base is a locked nucleic acid
  modified_base (11)..(11): base is a locked nucleic acid
  modified_base (12)..(12): base is a locked nucleic acid
aaaaaagaaraaatcagtr

SEQ ID NO: 4216 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (9)..(9): base is a locked nucleic acid
  modified_base (11)..(11): base is a locked nucleic acid
  modified_base (18)..(18): base is a locked nucleic acid
aaaaaagaaraaatcagtr

SEQ ID NO: 4217 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (6)..(6): base is a locked nucleic acid
  modified_base (9)..(9): base is a locked nucleic acid
  modified_base (11)..(11): base is a locked nucleic acid
aaaaaagaaraaatcagtr

SEQ ID NO: 4218 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (3)..(3): base is a locked nucleic acid
  modified_base (9)..(9): base is a locked nucleic acid
  modified_base (11)..(11): base is a locked nucleic acid
aaaaaagaaraaatcagtr

SEQ ID NO: 4219 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (2)..(2): base is a locked nucleic acid
  modified_base (9)..(9): base is a locked nucleic acid
  modified_base (11)..(11): base is a locked nucleic acid
aaaaaagaaraaatcagtr

SEQ ID NO: 4220 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (5)..(5): base is a locked nucleic acid
  modified_base (9)..(9): base is a locked nucleic acid
  modified_base (11)..(11): base is a locked nucleic acid
aaaaaagaaraaatcagtr

SEQ ID NO: 4221 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
  modified_base (9)..(9): base is a locked nucleic acid
  modified_base (11)..(11): base is a locked nucleic acid
aaaaaagaaraaatcagtr

SEQ ID NO: 4222 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (14)..(14): base is a locked nucleic acid
aaaaagaaraaatcagt

SEQ ID NO: 4223 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (15)..(15): base is a locked nucleic acid
aaaaagaaraaatcagt

SEQ ID NO: 4224 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (10)..(10): base is a locked nucleic acid
aaaaagaaraaatcagt

SEQ ID NO: 4225 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (16)..(16): base is a locked nucleic acid
aaaaagaaraaatcagt

SEQ ID NO: 4226 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (3)..(3): base is a locked nucleic acid
aaaaagaaraaatcagt

SEQ ID NO: 4227 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (4)..(4): base is a locked nucleic acid
aaaaagaaraaatcagt

SEQ ID NO: 4228 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (7)..(7): base is a locked nucleic acid
aaaaagaaraaatcagt

SEQ ID NO: 4229 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (5)..(5): base is a locked nucleic acid
aaaaagaaraaatcagt

SEQ ID NO: 4230 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
  modified_base (16)..(16): base is a locked nucleic acid
aaaaagaaraaatcagt

SEQ ID NO: 4231 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
  modified_base (14)..(14): base is a locked nucleic acid
aaaaagaaraaatcagt

SEQ ID NO: 4232 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
  modified_base (11)..(11): base is a locked nucleic acid
aaaaagaaraaatcagt

SEQ ID NO: 4233 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
  modified_base (17)..(17): base is a locked nucleic acid
aaaaagaaraaatcagt

SEQ ID NO: 4234 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (5)..(5): base is a locked nucleic acid
  modified_base (8)..(8): base is a locked nucleic acid
  modified_base (10)..(10): base is a locked nucleic acid
aaaaagaaraaatcagt

SEQ ID NO: 4235 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (2)..(2): base is a locked nucleic acid
  modified_base (8)..(8): base is a locked nucleic acid
  modified_base (10)..(10): base is a locked nucleic acid
aaaaagaaraaatcagt

SEQ ID NO: 4236 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (1)..(1): base is a locked nucleic acid
  modified_base (8)..(8): base is a locked nucleic acid
  modified_base (10)..(10): base is a locked nucleic acid
aaaaagaaraaatcagt

SEQ ID NO: 4237 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (4)..(4): base is a locked nucleic acid
  modified_base (8)..(8): base is a locked nucleic acid
  modified_base (10)..(10): base is a locked nucleic acid
aaaaagaaraaatcagt

SEQ ID NO: 4238 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
aaaaagaaraaatcagt

SEQ ID NO: 4239 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (14)..(14): base is a locked nucleic acid
aaaaagaaraaatca

SEQ ID NO: 4240 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (15)..(15): base is a locked nucleic acid
aaaaagaaraaatca

SEQ ID NO: 4241 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (10)..(10): base is a locked nucleic acid
aaaaagaaraaatca

SEQ ID NO: 4242 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
aaaaagaaraaatca

SEQ ID NO: 4243 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (3)..(3): base is a locked nucleic acid
aaaaagaaraaatca

SEQ ID NO: 4244 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (4)..(4): base is a locked nucleic acid
aaaaagaaraaatca

SEQ ID NO: 4245 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (7)..(7): base is a locked nucleic acid
aaaaagaaraaatca

SEQ ID NO: 4246 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (5)..(5): base is a locked nucleic acid
aaaaagaaraaatca

SEQ ID NO: 4247 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
aaaaagaaraaatca

SEQ ID NO: 4248 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
  modified_base (14)..(14): base is a locked nucleic acid
aaaaagaaraaatca

SEQ ID NO: 4249 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
  modified_base (11)..(11): base is a locked nucleic acid
aaaaagaaraaatca

SEQ ID NO: 4250 - DNA, 16 bp, Artificial Sequence
  Oligonucleotide probe
  misc_binding (1)..(16): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
aaaaagaaraaatcag

SEQ ID NO: 4251 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (5)..(5): base is a locked nucleic acid
  modified_base (8)..(8): base is a locked nucleic acid
  modified_base (10)..(10): base is a locked nucleic acid
aaaaagaaraaatca

SEQ ID NO: 4252 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (2)..(2): base is a locked nucleic acid
  modified_base (8)..(8): base is a locked nucleic acid
  modified_base (10)..(10): base is a locked nucleic acid
aaaaagaaraaatca

SEQ ID NO: 4253 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (1)..(1): base is a locked nucleic acid
  modified_base (8)..(8): base is a locked nucleic acid
  modified_base (10)..(10): base is a locked nucleic acid
aaaaagaaraaatca

SEQ ID NO: 4254 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (4)..(4): base is a locked nucleic acid
  modified_base (8)..(8): base is a locked nucleic acid
  modified_base (10)..(10): base is a locked nucleic acid
aaaaagaaraaatca

SEQ ID NO: 4255 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
aaaaagaaraaatca

SEQ ID NO: 4256 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
aaaaagaaraaat

SEQ ID NO: 4257 - DNA, 14 bp, Artificial Sequence
  Oligonucleotide probe
  misc_binding (1)..(14): Hybridization probe for the specific detection of wild-type HIV-1 at codon 103 of the reverse transcriptase gene.
aaaaagaaraaatc

SEQ ID NO: 4258 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (10)..(10): base is a locked nucleic acid
aaaaagaaraaat

SEQ ID NO: 4259 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (3)..(3): base is a locked nucleic acid
aaaaagaaraaat

SEQ ID NO: 4260 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (4)..(4): base is a locked nucleic acid
aaaaagaaraaat

SEQ ID NO: 4261 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (7)..(7): base is a locked nucleic acid
aaaaagaaraaat

SEQ ID NO: 4262 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (5)..(5): base is a locked nucleic acid
aaaaagaaraaat

SEQ ID NO: 4263 - DNA, 14 bp, Artificial Sequence
  Oligonucleotide probe
  misc_binding (1)..(14): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
aaaaagaaraaatc

SEQ ID NO: 4264 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
aaaaagaaraaat

SEQ ID NO: 4265 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
  modified_base (11)..(11): base is a locked nucleic acid
aaaaagaaraaat

SEQ ID NO: 4266 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (5)..(5): base is a locked nucleic acid
  modified_base (8)..(8): base is a locked nucleic acid
  modified_base (10)..(10): base is a locked nucleic acid
aaaaagaaraaat

SEQ ID NO: 4267 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (2)..(2): base is a locked nucleic acid
  modified_base (8)..(8): base is a locked nucleic acid
  modified_base (10)..(10): base is a locked nucleic acid
aaaaagaaraaat

SEQ ID NO: 4268 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (1)..(1): base is a locked nucleic acid
  modified_base (8)..(8): base is a locked nucleic acid
  modified_base (10)..(10): base is a locked nucleic acid
aaaaagaaraaat

SEQ ID NO: 4269 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (4)..(4): base is a locked nucleic acid
  modified_base (8)..(8): base is a locked nucleic acid
  modified_base (10)..(10): base is a locked nucleic acid
aaaaagaaraaat

SEQ ID NO: 4270 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
  modified_base (8)..(8): base is a locked nucleic acid
  modified_base (10)..(10): base is a locked nucleic acid
aaaaagaaraaat

SEQ ID NO: 4271 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
aaaagaaraaatcag

SEQ ID NO: 4272 - DNA, 19 bp, Artificial Sequence
  Oligonucleotide probe
  misc_binding (1)..(19): Hybridization probe for the specific detection of wild-type HIV-1 at codon 103 of the reverse transcriptase gene.
aaaaaagaaraaatcagtr

SEQ ID NO: 4273 - DNA, 17 bp, Artificial Sequence
  Oligonucleotide probe
  misc_binding (1)..(17): Hybridization probe for the specific detection of wild-type HIV-1 at codon 103 of the reverse transcriptase gene.
aaaaagaaraaatcagt

SEQ ID NO: 4274 - DNA, 15 bp, Artificial Sequence
  Oligonucleotide probe
  misc_binding (1)..(15): Hybridization probe for the specific detection of wild-type HIV-1 at codon 103 of the reverse transcriptase gene.
aaaaagaaraaatca

SEQ ID NO: 4275 - DNA, 16 bp, Artificial Sequence
  Oligonucleotide probe
  misc_binding (1)..(16): Hybridization probe for the specific detection of wild-type HIV-1 at codon 103 of the reverse transcriptase gene.
aaaaagaaraaatcag

SEQ ID NO: 4276 - DNA, 13 bp, Artificial Sequence
  Oligonucleotide probe
  misc_binding (1)..(13): Hybridization probe for the specific detection of wild-type HIV-1 at codon 103 of the reverse transcriptase gene.
aaaaagaaraaat

SEQ ID NO: 4277 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (13)..(13): base is a locked nucleic acid
amaaatcagtracagtryt

SEQ ID NO: 4278 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (19)..(19): base is a locked nucleic acid
amaaatcagtracagtryt

SEQ ID NO: 4279 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (12)..(12): base is a locked nucleic acid
amaaatcagtracagtryt

SEQ ID NO: 4280 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (18)..(18): base is a locked nucleic acid
amaaatcagtracagtryt

SEQ ID NO: 4281 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (17)..(17): base is a locked nucleic acid
amaaatcagtracagtryt

SEQ ID NO: 4282 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (15)..(15): base is a locked nucleic acid
amaaatcagtracagtryt

SEQ ID NO: 4283 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (6)..(6): base is a locked nucleic acid
amaaatcagtracagtryt

SEQ ID NO: 4284 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (5)..(5): base is a locked nucleic acid
amaaatcagtracagtryt

SEQ ID NO: 4285 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (7)..(7): base is a locked nucleic acid
amaaatcagtracagtryt

SEQ ID NO: 4286 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
amaaatcagtracagtryt

SEQ ID NO: 4287 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (4)..(4): base is a locked nucleic acid
amaaatcagtracagtryt

SEQ ID NO: 4288 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (3)..(3): base is a locked nucleic acid
amaaatcagtracagtryt

SEQ ID NO: 4289 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (8)..(8): base is a locked nucleic acid
amaaatcagtracagtryt

SEQ ID NO: 4290 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (2)..(2): base is a locked nucleic acid
amaaatcagtracagtryt

SEQ ID NO: 4291 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
  modified_base (11)..(11): base is a locked nucleic acid
  modified_base (18)..(18): base is a locked nucleic acid
amaaatcagtracagtryt

SEQ ID NO: 4292 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
  modified_base (11)..(11): base is a locked nucleic acid
  modified_base (19)..(19): base is a locked nucleic acid
amaaatcagtracagtryt

SEQ ID NO: 4293 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
  modified_base (11)..(11): base is a locked nucleic acid
  modified_base (13)..(13): base is a locked nucleic acid
amaaatcagtracagtryt

SEQ ID NO: 4294 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
  modified_base (11)..(11): base is a locked nucleic acid
  modified_base (15)..(15): base is a locked nucleic acid
amaaatcagtracagtryt

SEQ ID NO: 4295 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
  modified_base (11)..(11): base is a locked nucleic acid
  modified_base (12)..(12): base is a locked nucleic acid
amaaatcagtracagtryt

SEQ ID NO: 4296 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
  modified_base (11)..(11): base is a locked nucleic acid
  modified_base (17)..(17): base is a locked nucleic acid
amaaatcagtracagtryt

SEQ ID NO: 4297 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (4)..(4): base is a locked nucleic acid
  modified_base (9)..(9): base is a locked nucleic acid
  modified_base (11)..(11): base is a locked nucleic acid
amaaatcagtracagtryt

SEQ ID NO: 4298 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (5)..(5): base is a locked nucleic acid
  modified_base (9)..(9): base is a locked nucleic acid
  modified_base (11)..(11): base is a locked nucleic acid
amaaatcagtracagtryt

SEQ ID NO: 4299 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (3)..(3): base is a locked nucleic acid
  modified_base (9)..(9): base is a locked nucleic acid
  modified_base (11)..(11): base is a locked nucleic acid
amaaatcagtracagtryt

SEQ ID NO: 4300 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (7)..(7): base is a locked nucleic acid
  modified_base (9)..(9): base is a locked nucleic acid
  modified_base (11)..(11): base is a locked nucleic acid
amaaatcagtracagtryt

SEQ ID NO: 4301 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (6)..(6): base is a locked nucleic acid
  modified_base (9)..(9): base is a locked nucleic acid
  modified_base (11)..(11): base is a locked nucleic acid
amaaatcagtracagtryt

SEQ ID NO: 4302 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (2)..(2): base is a locked nucleic acid
  modified_base (9)..(9): base is a locked nucleic acid
  modified_base (11)..(11): base is a locked nucleic acid
amaaatcagtracagtryt

SEQ ID NO: 4303 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
  modified_base (9)..(9): base is a locked nucleic acid
  modified_base (11)..(11): base is a locked nucleic acid
amaaatcagtracagtryt

SEQ ID NO: 4304 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (12)..(12): base is a locked nucleic acid
maaatcagtracagtry

SEQ ID NO: 4305 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
maaatcagtracagtry

SEQ ID NO: 4306 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (11)..(11): base is a locked nucleic acid
maaatcagtracagtry

SEQ ID NO: 4307 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (17)..(17): base is a locked nucleic acid
maaatcagtracagtry

SEQ ID NO: 4308 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (16)..(16): base is a locked nucleic acid
maaatcagtracagtry

SEQ ID NO: 4309 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (14)..(14): base is a locked nucleic acid
maaatcagtracagtry

SEQ ID NO: 4310 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (5)..(5): base is a locked nucleic acid
maaatcagtracagtry

SEQ ID NO: 4311 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (4)..(4): base is a locked nucleic acid
maaatcagtracagtry

SEQ ID NO: 4312 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (6)..(6): base is a locked nucleic acid
maaatcagtracagtry

SEQ ID NO: 4313 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
maaatcagtracagtry

SEQ ID NO: 4314 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (3)..(3): base is a locked nucleic acid
maaatcagtracagtry

SEQ ID NO: 4315 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (2)..(2): base is a locked nucleic acid
maaatcagtracagtry

SEQ ID NO: 4316 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (7)..(7): base is a locked nucleic acid
maaatcagtracagtry

SEQ ID NO: 4317 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (1)..(1): base is a locked nucleic acid
maaatcagtracagtry

SEQ ID NO: 4318 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (17)..(17): base is a locked nucleic acid
maaatcagtracagtry

SEQ ID NO: 4319 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtracagtry

SEQ ID NO: 4320 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (12)..(12): base is a locked nucleic acid
maaatcagtracagtry

SEQ ID NO: 4321 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (14)..(14): base is a locked nucleic acid
maaatcagtracagtry

SEQ ID NO: 4322 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (11)..(11): base is a locked nucleic acid
maaatcagtracagtry

SEQ ID NO: 4323 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (16)..(16): base is a locked nucleic acid
maaatcagtracagtry

SEQ ID NO: 4324 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (3)..(3): base is a locked nucleic acid
  modified_base (8)..(8): base is a locked nucleic acid
  modified_base (10)..(10): base is a locked nucleic acid
maaatcagtracagtry

SEQ ID NO: 4325 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (4)..(4): base is a locked nucleic acid
  modified_base (8)..(8): base is a locked nucleic acid
  modified_base (10)..(10): base is a locked nucleic acid
maaatcagtracagtry

SEQ ID NO: 4326 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (2)..(2): base is a locked nucleic acid
  modified_base (8)..(8): base is a locked nucleic acid
  modified_base (10)..(10): base is a locked nucleic acid
maaatcagtracagtry

SEQ ID NO: 4327 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (6)..(6): base is a locked nucleic acid
  modified_base (8)..(8): base is a locked nucleic acid
  modified_base (10)..(10): base is a locked nucleic acid
maaatcagtracagtry

SEQ ID NO: 4328 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (5)..(5): base is a locked nucleic acid
  modified_base (8)..(8): base is a locked nucleic acid
  modified_base (10)..(10): base is a locked nucleic acid
maaatcagtracagtry

SEQ ID NO: 4329 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (1)..(1): base is a locked nucleic acid
  modified_base (8)..(8): base is a locked nucleic acid
  modified_base (10)..(10): base is a locked nucleic acid
maaatcagtracagtry

SEQ ID NO: 4330 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtracagtry

SEQ ID NO: 4331 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (12)..(12): base is a locked nucleic acid
maaatcagtracagt

SEQ ID NO: 4332 - DNA, 16 bp, Artificial Sequence
  Oligonucleotide probe
  misc_binding (1)..(16): Hybridization probe for the specific detection of wild-type HIV-1 at codon 106 of the reverse transcriptase gene.
maaatcagtracagtr

SEQ ID NO: 4333 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (11)..(11): base is a locked nucleic acid
maaatcagtracagt

SEQ ID NO: 4334 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
maaatcagtracagt

SEQ ID NO: 4335 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (14)..(14): base is a locked nucleic acid
maaatcagtracagt

SEQ ID NO: 4336 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (5)..(5): base is a locked nucleic acid
maaatcagtracagt

SEQ ID NO: 4337 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (4)..(4): base is a locked nucleic acid
maaatcagtracagt

SEQ ID NO: 4338 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (6)..(6): base is a locked nucleic acid
maaatcagtracagt

SEQ ID NO: 4339 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (8)..(8): base is a locked nucleic acid
maaatcagtracagt

SEQ ID NO: 4340 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (3)..(3): base is a locked nucleic acid
maaatcagtracagt

SEQ ID NO: 4341 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (2)..(2): base is a locked nucleic acid
maaatcagtracagt

SEQ ID NO: 4342 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (7)..(7): base is a locked nucleic acid
maaatcagtracagt

SEQ ID NO: 4343 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (1)..(1): base is a locked nucleic acid
maaatcagtracagt

SEQ ID NO: 4344 - DNA, 16 bp, Artificial Sequence
  Oligonucleotide probe
  misc_binding (1)..(16): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtracagtr

SEQ ID NO: 4345 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (12)..(12): base is a locked nucleic acid
maaatcagtracagt

SEQ ID NO: 4346 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (14)..(14): base is a locked nucleic acid
maaatcagtracagt

SEQ ID NO: 4347 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (11)..(11): base is a locked nucleic acid
maaatcagtracagt

SEQ ID NO: 4348 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtracagt

SEQ ID NO: 4349 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (3)..(3): base is a locked nucleic acid
  modified_base (8)..(8): base is a locked nucleic acid
  modified_base (10)..(10): base is a locked nucleic acid
maaatcagtracagt

SEQ ID NO: 4350 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (4)..(4): base is a locked nucleic acid
  modified_base (8)..(8): base is a locked nucleic acid
  modified_base (10)..(10): base is a locked nucleic acid
maaatcagtracagt

SEQ ID NO: 4351 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (2)..(2): base is a locked nucleic acid
  modified_base (8)..(8): base is a locked nucleic acid
  modified_base (10)..(10): base is a locked nucleic acid
maaatcagtracagt

SEQ ID NO: 4352 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (6)..(6): base is a locked nucleic acid
  modified_base (8)..(8): base is a locked nucleic acid
  modified_base (10)..(10): base is a locked nucleic acid
maaatcagtracagt

SEQ ID NO: 4353 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (5)..(5): base is a locked nucleic acid
  modified_base (8)..(8): base is a locked nucleic acid
  modified_base (10)..(10): base is a locked nucleic acid
maaatcagtracagt

SEQ ID NO: 4354 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (1)..(1): base is a locked nucleic acid
  modified_base (8)..(8): base is a locked nucleic acid
  modified_base (10)..(10): base is a locked nucleic acid
maaatcagtracagt

SEQ ID NO: 4355 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtracagt

SEQ ID NO: 4356 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (12)..(12): base is a locked nucleic acid
maaatcagtraca

SEQ ID NO: 4357 - DNA, 14 bp, Artificial Sequence
  Oligonucleotide probe
  misc_binding (1)..(14): Hybridization probe for the specific detection of wild-type HIV-1 at codon 106 of the reverse transcriptase gene.
maaatcagtracag

SEQ ID NO: 4358 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (11)..(11): base is a locked nucleic acid
maaatcagtraca

SEQ ID NO: 4359 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
maaatcagtraca

SEQ ID NO: 4360 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (5)..(5): base is a locked nucleic acid
maaatcagtraca

SEQ ID NO: 4361 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (4)..(4): base is a locked nucleic acid
maaatcagtraca

SEQ ID NO: 4362 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (6)..(6): base is a locked nucleic acid
maaatcagtraca

SEQ ID NO: 4363 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (8)..(8): base is a locked nucleic acid
maaatcagtraca

SEQ ID NO: 4364 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (3)..(3): base is a locked nucleic acid
maaatcagtraca

SEQ ID NO: 4365 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (2)..(2): base is a locked nucleic acid
maaatcagtraca

SEQ ID NO: 4366 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (7)..(7): base is a locked nucleic acid
maaatcagtraca

SEQ ID NO: 4367 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (1)..(1): base is a locked nucleic acid
maaatcagtraca

SEQ ID NO: 4368 - DNA, 14 bp, Artificial Sequence
  Oligonucleotide probe
  misc_binding (1)..(14): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtracag

SEQ ID NO: 4369 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (12)..(12): base is a locked nucleic acid
maaatcagtraca

SEQ ID NO: 4370 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtraca

SEQ ID NO: 4371 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
  modified_base (11)..(11): base is a locked nucleic acid
maaatcagtraca

SEQ ID NO: 4372 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (3)..(3): base is a locked nucleic acid
  modified_base (8)..(8): base is a locked nucleic acid
  modified_base (10)..(10): base is a locked nucleic acid
maaatcagtraca

SEQ ID NO: 4373 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (4)..(4): base is a locked nucleic acid
  modified_base (8)..(8): base is a locked nucleic acid
  modified_base (10)..(10): base is a locked nucleic acid
maaatcagtraca

SEQ ID NO: 4374 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (2)..(2): base is a locked nucleic acid
  modified_base (8)..(8): base is a locked nucleic acid
  modified_base (10)..(10): base is a locked nucleic acid
maaatcagtraca

SEQ ID NO: 4375 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (6)..(6): base is a locked nucleic acid
  modified_base (8)..(8): base is a locked nucleic acid
  modified_base (10)..(10): base is a locked nucleic acid
maaatcagtraca

SEQ ID NO: 4376 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (5)..(5): base is a locked nucleic acid
  modified_base (8)..(8): base is a locked nucleic acid
  modified_base (10)..(10): base is a locked nucleic acid
maaatcagtraca

SEQ ID NO: 4377 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (1)..(1): base is a locked nucleic acid
  modified_base (8)..(8): base is a locked nucleic acid
  modified_base (10)..(10): base is a locked nucleic acid
maaatcagtraca

SEQ ID NO: 4378 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
  modified_base (8)..(8): base is a locked nucleic acid
  modified_base (10)..(10): base is a locked nucleic acid
maaatcagtraca

SEQ ID NO: 4379 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
aaatcagtracagta

SEQ ID NO: 4380 - DNA, 19 bp, Artificial Sequence
  Oligonucleotide probe
  misc_binding (1)..(19): Hybridization probe for the specific detection of wild-type HIV-1 at codon 106 of the reverse transcriptase gene.
amaaatcagtracagtryt

SEQ ID NO: 4381 - DNA, 17 bp, Artificial Sequence
  Oligonucleotide probe
  misc_binding (1)..(17): Hybridization probe for the specific detection of wild-type HIV-1 at codon 106 of the reverse transcriptase gene.
maaatcagtracagtry

SEQ ID NO: 4382 - DNA, 15 bp, Artificial Sequence
  Oligonucleotide probe
  misc_binding (1)..(15): Hybridization probe for the specific detection of wild-type HIV-1 at codon 106 of the reverse transcriptase gene.
maaatcagtracagt

SEQ ID NO: 4383 - DNA, 13 bp, Artificial Sequence
  Oligonucleotide probe
  misc_binding (1)..(13): Hybridization probe for the specific detection of wild-type HIV-1 at codon 106 of the reverse transcriptase gene.
maaatcagtraca

SEQ ID NO: 4384 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (12)..(12): base is a locked nucleic acid
tcagtracaatrytrgatg

SEQ ID NO: 4385 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (14)..(14): base is a locked nucleic acid
tcagtracaatrytrgatg

SEQ ID NO: 4386 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (17)..(17): base is a locked nucleic acid
tcagtracaatrytrgatg

SEQ ID NO: 4387 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (16)..(16): base is a locked nucleic acid
tcagtracaatrytrgatg

SEQ ID NO: 4388 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (3)..(3): base is a locked nucleic acid
tcagtracaatrytrgatg

SEQ ID NO: 4389 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (2)..(2): base is a locked nucleic acid
tcagtracaatrytrgatg

SEQ ID NO: 4390 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (4)..(4): base is a locked nucleic acid
tcagtracaatrytrgatg

SEQ ID NO: 4391 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (6)..(6): base is a locked nucleic acid
tcagtracaatrytrgatg

SEQ ID NO: 4392 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (9)..(9): base is a locked nucleic acid
  modified_base (11)..(11): base is a locked nucleic acid
  modified_base (16)..(16): base is a locked nucleic acid
tcagtracaatrytrgatg

SEQ ID NO: 4393 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (9)..(9): base is a locked nucleic acid
  modified_base (11)..(11): base is a locked nucleic acid
  modified_base (19)..(19): base is a locked nucleic acid
tcagtracaatrytrgatg

SEQ ID NO: 4394 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (9)..(9): base is a locked nucleic acid
  modified_base (11)..(11): base is a locked nucleic acid
  modified_base (15)..(15): base is a locked nucleic acid
tcagtracaatrytrgatg

SEQ ID NO: 4395 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (9)..(9): base is a locked nucleic acid
  modified_base (11)..(11): base is a locked nucleic acid
  modified_base (13)..(13): base is a locked nucleic acid
tcagtracaatrytrgatg

SEQ ID NO: 4396 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (5)..(5): base is a locked nucleic acid
  modified_base (9)..(9): base is a locked nucleic acid
  modified_base (11)..(11): base is a locked nucleic acid
tcagtracaatrytrgatg

SEQ ID NO: 4397 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (3)..(3): base is a locked nucleic acid
  modified_base (9)..(9): base is a locked nucleic acid
  modified_base (11)..(11): base is a locked nucleic acid
tcagtracaatrytrgatg

SEQ ID NO: 4398 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (4)..(4): base is a locked nucleic acid
  modified_base (9)..(9): base is a locked nucleic acid
  modified_base (11)..(11): base is a locked nucleic acid
tcagtracaatrytrgatg

SEQ ID NO: 4399 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (8)..(8): base is a locked nucleic acid
  modified_base (9)..(9): base is a locked nucleic acid
  modified_base (11)..(11): base is a locked nucleic acid
tcagtracaatrytrgatg

SEQ ID NO: 4400 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
  modified_base (9)..(9): base is a locked nucleic acid
  modified_base (11)..(11): base is a locked nucleic acid
tcagtracaatrytrgatg

SEQ ID NO: 4401 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (11)..(11): base is a locked nucleic acid
cagtracaatrytrgat

SEQ ID NO: 4402 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (13)..(13): base is a locked nucleic acid
cagtracaatrytrgat

SEQ ID NO: 4403 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (16)..(16): base is a locked nucleic acid
cagtracaatrytrgat

SEQ ID NO: 4404 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (15)..(15): base is a locked nucleic acid
cagtracaatrytrgat

SEQ ID NO: 4405 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (2)..(2): base is a locked nucleic acid
cagtracaatrytrgat

SEQ ID NO: 4406 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (1)..(1): base is a locked nucleic acid
cagtracaatrytrgat

SEQ ID NO: 4407 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (3)..(3): base is a locked nucleic acid
cagtracaatrytrgat

SEQ ID NO: 4408 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (5)..(5): base is a locked nucleic acid
cagtracaatrytrgat

SEQ ID NO: 4409 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
  modified_base (15)..(15): base is a locked nucleic acid
cagtracaatrytrgat

SEQ ID NO: 4410 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
cagtracaatrytrgat

SEQ ID NO: 4411 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
  modified_base (14)..(14): base is a locked nucleic acid
cagtracaatrytrgat

SEQ ID NO: 4412 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
  modified_base (12)..(12): base is a locked nucleic acid
cagtracaatrytrgat

SEQ ID NO: 4413 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (4)..(4): base is a locked nucleic acid
  modified_base (8)..(8): base is a locked nucleic acid
  modified_base (10)..(10): base is a locked nucleic acid
cagtracaatrytrgat

SEQ ID NO: 4414 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (2)..(2): base is a locked nucleic acid
  modified_base (8)..(8): base is a locked nucleic acid
  modified_base (10)..(10): base is a locked nucleic acid
cagtracaatrytrgat

SEQ ID NO: 4415 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (3)..(3): base is a locked nucleic acid
  modified_base (8)..(8): base is a locked nucleic acid
  modified_base (10)..(10): base is a locked nucleic acid
cagtracaatrytrgat

SEQ ID NO: 4416 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (7)..(7): base is a locked nucleic acid
  modified_base (8)..(8): base is a locked nucleic acid
  modified_base (10)..(10): base is a locked nucleic acid
cagtracaatrytrgat

SEQ ID NO: 4417 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
cagtracaatrytrgat

SEQ ID NO: 4418 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (11)..(11): base is a locked nucleic acid
cagtracaatrytrg

SEQ ID NO: 4419 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (13)..(13): base is a locked nucleic acid
cagtracaatrytrg

SEQ ID NO: 4420 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
cagtracaatrytrg

SEQ ID NO: 4421 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (15)..(15): base is a locked nucleic acid
cagtracaatrytrg

SEQ ID NO: 4422 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (2)..(2): base is a locked nucleic acid
cagtracaatrytrg

SEQ ID NO: 4423 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (1)..(1): base is a locked nucleic acid
cagtracaatrytrg

SEQ ID NO: 4424 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (3)..(3): base is a locked nucleic acid
cagtracaatrytrg

SEQ ID NO: 4425 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (5)..(5): base is a locked nucleic acid
cagtracaatrytrg

SEQ ID NO: 4426 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
  modified_base (15)..(15): base is a locked nucleic acid
cagtracaatrytrg

SEQ ID NO: 4427 - DNA, 16 bp, Artificial Sequence
  Oligonucleotide probe
  misc_binding (1)..(16): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
cagtracaatrytrga

SEQ ID NO: 4428 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
  modified_base (14)..(14): base is a locked nucleic acid
cagtracaatrytrg

SEQ ID NO: 4429 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
  modified_base (12)..(12): base is a locked nucleic acid
cagtracaatrytrg

SEQ ID NO: 4430 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (4)..(4): base is a locked nucleic acid
  modified_base (8)..(8): base is a locked nucleic acid
  modified_base (10)..(10): base is a locked nucleic acid
cagtracaatrytrg

SEQ ID NO: 4431 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (2)..(2): base is a locked nucleic acid
  modified_base (8)..(8): base is a locked nucleic acid
  modified_base (10)..(10): base is a locked nucleic acid
cagtracaatrytrg

SEQ ID NO: 4432 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (3)..(3): base is a locked nucleic acid
  modified_base (8)..(8): base is a locked nucleic acid
  modified_base (10)..(10): base is a locked nucleic acid
cagtracaatrytrg

SEQ ID NO: 4433 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (7)..(7): base is a locked nucleic acid
  modified_base (8)..(8): base is a locked nucleic acid
  modified_base (10)..(10): base is a locked nucleic acid
cagtracaatrytrg

SEQ ID NO: 4434 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
cagtracaatrytrg

SEQ ID NO: 4435 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (11)..(11): base is a locked nucleic acid
cagtracaatryt

SEQ ID NO: 4436 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (13)..(13): base is a locked nucleic acid
cagtracaatryt

SEQ ID NO: 4437 - DNA, 14 bp, Artificial Sequence
  Oligonucleotide probe
  misc_binding (1)..(14): Hybridization probe for the specific detection of wild-type HIV-1 at codon 108 of the reverse transcriptase gene.
cagtracaatrytr

SEQ ID NO: 4438 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (2)..(2): base is a locked nucleic acid
cagtracaatryt

SEQ ID NO: 4439 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (1)..(1): base is a locked nucleic acid
cagtracaatryt

SEQ ID NO: 4440 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (3)..(3): base is a locked nucleic acid
cagtracaatryt

SEQ ID NO: 4441 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (5)..(5): base is a locked nucleic acid
cagtracaatryt

SEQ ID NO: 4442 - DNA, 14 bp, Artificial Sequence
  Oligonucleotide probe
  misc_binding (1)..(14): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
cagtracaatrytr

SEQ ID NO: 4443 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
cagtracaatryt

SEQ ID NO: 4444 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
  modified_base (12)..(12): base is a locked nucleic acid
cagtracaatryt

SEQ ID NO: 4445 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (4)..(4): base is a locked nucleic acid
  modified_base (8)..(8): base is a locked nucleic acid
  modified_base (10)..(10): base is a locked nucleic acid
cagtracaatryt

SEQ ID NO: 4446 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (2)..(2): base is a locked nucleic acid
  modified_base (8)..(8): base is a locked nucleic acid
  modified_base (10)..(10): base is a locked nucleic acid
cagtracaatryt

SEQ ID NO: 4447 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (3)..(3): base is a locked nucleic acid
  modified_base (8)..(8): base is a locked nucleic acid
  modified_base (10)..(10): base is a locked nucleic acid
cagtracaatryt

SEQ ID NO: 4448 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (7)..(7): base is a locked nucleic acid
  modified_base (8)..(8): base is a locked nucleic acid
  modified_base (10)..(10): base is a locked nucleic acid
cagtracaatryt

SEQ ID NO: 4449 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
  modified_base (8)..(8): base is a locked nucleic acid
  modified_base (10)..(10): base is a locked nucleic acid
cagtracaatryt

SEQ ID NO: 4450 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
  misc_feature (7)..(7): n is a, c, g, or t
atccagnactgttac

SEQ ID NO: 4451 - DNA, 19 bp, Artificial Sequence
  Oligonucleotide probe
  misc_binding (1)..(19): Hybridization probe for the specific detection of wild-type HIV-1 at codon 108 of the reverse transcriptase gene.
tcagtracaatrytrgatg

SEQ ID NO: 4452 - DNA, 17 bp, Artificial Sequence
  Oligonucleotide probe
  misc_binding (1)..(17): Hybridization probe for the specific detection of wild-type HIV-1 at codon 108 of the reverse transcriptase gene.
cagtracaatrytrgat

SEQ ID NO: 4453 - DNA, 15 bp, Artificial Sequence
  Oligonucleotide probe
  misc_binding (1)..(15): Hybridization probe for the specific detection of wild-type HIV-1 at codon 108 of the reverse transcriptase gene.
cagtracaatrytrg

SEQ ID NO: 4454 - DNA, 16 bp, Artificial Sequence
  Oligonucleotide probe
  misc_binding (1)..(16): Hybridization probe for the specific detection of wild-type HIV-1 at codon 108 of the reverse transcriptase gene.
cagtracaatrytrga

SEQ ID NO: 4455 - DNA, 13 bp, Artificial Sequence
  Oligonucleotide probe
  misc_binding (1)..(13): Hybridization probe for the specific detection of wild-type HIV-1 at codon 108 of the reverse transcriptase gene.
cagtracaatryt

SEQ ID NO: 4456 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (12)..(12): base is a locked nucleic acid
gdgaygcatayttytcagt

SEQ ID NO: 4457 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (14)..(14): base is a locked nucleic acid
gdgaygcatayttytcagt

SEQ ID NO: 4458 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (11)..(11): base is a locked nucleic acid
gdgaygcatayttytcagt

SEQ ID NO: 4459 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (19)..(19): base is a locked nucleic acid
gdgaygcatayttytcagt

SEQ ID NO: 4460 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (8)..(8): base is a locked nucleic acid
gdgaygcatayttytcagt

SEQ ID NO: 4461 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (5)..(5): base is a locked nucleic acid
gdgaygcatayttytcagt

SEQ ID NO: 4462 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (2)..(2): base is a locked nucleic acid
gdgaygcatayttytcagt

SEQ ID NO: 4463 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (4)..(4): base is a locked nucleic acid
gdgaygcatayttytcagt

SEQ ID NO: 4464 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (9)..(9): base is a locked nucleic acid
  modified_base (11)..(11): base is a locked nucleic acid
  modified_base (13)..(13): base is a locked nucleic acid
gdgaygcatayttytcagt

SEQ ID NO: 4465 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (9)..(9): base is a locked nucleic acid
  modified_base (11)..(11): base is a locked nucleic acid
  modified_base (18)..(18): base is a locked nucleic acid
gdgaygcatayttytcagt

SEQ ID NO: 4466 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (9)..(9): base is a locked nucleic acid
  modified_base (11)..(11): base is a locked nucleic acid
  modified_base (12)..(12): base is a locked nucleic acid
gdgaygcatayttytcagt

SEQ ID NO: 4467 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (9)..(9): base is a locked nucleic acid
  modified_base (11)..(11): base is a locked nucleic acid
  modified_base (14)..(14): base is a locked nucleic acid
gdgaygcatayttytcagt

SEQ ID NO: 4468 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (4)..(4): base is a locked nucleic acid
  modified_base (9)..(9): base is a locked nucleic acid
  modified_base (11)..(11): base is a locked nucleic acid
gdgaygcatayttytcagt

SEQ ID NO: 4469 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (3)..(3): base is a locked nucleic acid
  modified_base (9)..(9): base is a locked nucleic acid
  modified_base (11)..(11): base is a locked nucleic acid
gdgaygcatayttytcagt

SEQ ID NO: 4470 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (6)..(6): base is a locked nucleic acid
  modified_base (9)..(9): base is a locked nucleic acid
  modified_base (11)..(11): base is a locked nucleic acid
gdgaygcatayttytcagt

SEQ ID NO: 4471 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (8)..(8): base is a locked nucleic acid
  modified_base (9)..(9): base is a locked nucleic acid
  modified_base (11)..(11): base is a locked nucleic acid
gdgaygcatayttytcagt

SEQ ID NO: 4472 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
  modified_base (9)..(9): base is a locked nucleic acid
  modified_base (11)..(11): base is a locked nucleic acid
gdgaygcatayttytcagt

SEQ ID NO: 4473 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (11)..(11): base is a locked nucleic acid
dgaygcatayttytcag

SEQ ID NO: 4474 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (13)..(13): base is a locked nucleic acid
dgaygcatayttytcag

SEQ ID NO: 4475 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (10)..(10): base is a locked nucleic acid
dgaygcatayttytcag

SEQ ID NO: 4476 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
dgaygcatayttytcag

SEQ ID NO: 4477 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (7)..(7): base is a locked nucleic acid
dgaygcatayttytcag

SEQ ID NO: 4478 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (4)..(4): base is a locked nucleic acid
dgaygcatayttytcag

SEQ ID NO: 4479 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (1)..(1): base is a locked nucleic acid
dgaygcatayttytcag

SEQ ID NO: 4480 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (3)..(3): base is a locked nucleic acid
dgaygcatayttytcag

SEQ ID NO: 4481 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (12)..(12): base is a locked nucleic acid
dgaygcatayttytcag

SEQ ID NO: 4482 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (17)..(17): base is a locked nucleic acid
dgaygcatayttytcag

SEQ ID NO: 4483 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (11)..(11): base is a locked nucleic acid
dgaygcatayttytcag

SEQ ID NO: 4484 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (13)..(13): base is a locked nucleic acid
dgaygcatayttytcag

SEQ ID NO: 4485 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (3)..(3): base is a locked nucleic acid
  modified_base (8)..(8): base is a locked nucleic acid
  modified_base (10)..(10): base is a locked nucleic acid
dgaygcatayttytcag

SEQ ID NO: 4486 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (2)..(2): base is a locked nucleic acid
  modified_base (8)..(8): base is a locked nucleic acid
  modified_base (10)..(10): base is a locked nucleic acid
dgaygcatayttytcag

SEQ ID NO: 4487 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (5)..(5): base is a locked nucleic acid
  modified_base (8)..(8): base is a locked nucleic acid
  modified_base (10)..(10): base is a locked nucleic acid
dgaygcatayttytcag

SEQ ID NO: 4488 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (7)..(7): base is a locked nucleic acid
  modified_base (8)..(8): base is a locked nucleic acid
  modified_base (10)..(10): base is a locked nucleic acid
dgaygcatayttytcag

SEQ ID NO: 4489 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
dgaygcatayttytcag

SEQ ID NO: 4490 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (11)..(11): base is a locked nucleic acid
dgaygcatayttytc

SEQ ID NO: 4491 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (13)..(13): base is a locked nucleic acid
dgaygcatayttytc

SEQ ID NO: 4492 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (10)..(10): base is a locked nucleic acid
dgaygcatayttytc

SEQ ID NO: 4493 - DNA, 16 bp, Artificial Sequence
  Oligonucleotide probe
  misc_binding (1)..(16): Hybridization probe for the specific detection of wild-type HIV-1 at codon 115 of the reverse transcriptase gene.
dgaygcatayttytca

SEQ ID NO: 4494 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (7)..(7): base is a locked nucleic acid
dgaygcatayttytc

SEQ ID NO: 4495 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (4)..(4): base is a locked nucleic acid
dgaygcatayttytc

SEQ ID NO: 4496 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (1)..(1): base is a locked nucleic acid
dgaygcatayttytc

SEQ ID NO: 4497 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (3)..(3): base is a locked nucleic acid
dgaygcatayttytc

SEQ ID NO: 4498 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (12)..(12): base is a locked nucleic acid
dgaygcatayttytc

SEQ ID NO: 4499 - DNA, 16 bp, Artificial Sequence
  Oligonucleotide probe
  misc_binding (1)..(16): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
dgaygcatayttytca

SEQ ID NO: 4500 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (11)..(11): base is a locked nucleic acid
dgaygcatayttytc

SEQ ID NO: 4501 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (13)..(13): base is a locked nucleic acid
dgaygcatayttytc

SEQ ID NO: 4502 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (3)..(3): base is a locked nucleic acid
  modified_base (8)..(8): base is a locked nucleic acid
  modified_base (10)..(10): base is a locked nucleic acid
dgaygcatayttytc

SEQ ID NO: 4503 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (2)..(2): base is a locked nucleic acid
  modified_base (8)..(8): base is a locked nucleic acid
  modified_base (10)..(10): base is a locked nucleic acid
dgaygcatayttytc

SEQ ID NO: 4504 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (5)..(5): base is a locked nucleic acid
  modified_base (8)..(8): base is a locked nucleic acid
  modified_base (10)..(10): base is a locked nucleic acid
dgaygcatayttytc

SEQ ID NO: 4505 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (7)..(7): base is a locked nucleic acid
  modified_base (8)..(8): base is a locked nucleic acid
  modified_base (10)..(10): base is a locked nucleic acid
dgaygcatayttytc

SEQ ID NO: 4506 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
dgaygcatayttytc

SEQ ID NO: 4507 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (11)..(11): base is a locked nucleic acid
dgaygcataytty

SEQ ID NO: 4508 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (13)..(13): base is a locked nucleic acid
dgaygcataytty

SEQ ID NO: 4509 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (10)..(10): base is a locked nucleic acid
dgaygcataytty

SEQ ID NO: 4510 - DNA, 14 bp, Artificial Sequence
  Oligonucleotide probe
  misc_binding (1)..(14): Hybridization probe for the specific detection of wild-type HIV-1 at codon 115 of the reverse transcriptase gene.
dgaygcatayttyt

SEQ ID NO: 4511 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (7)..(7): base is a locked nucleic acid
dgaygcataytty

SEQ ID NO: 4512 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (4)..(4): base is a locked nucleic acid
dgaygcataytty

SEQ ID NO: 4513 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (1)..(1): base is a locked nucleic acid
dgaygcataytty

SEQ ID NO: 4514 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (3)..(3): base is a locked nucleic acid
dgaygcataytty

SEQ ID NO: 4515 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (12)..(12): base is a locked nucleic acid
dgaygcataytty

SEQ ID NO: 4516 - DNA, 14 bp, Artificial Sequence
  Oligonucleotide probe
  misc_binding (1)..(14): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
dgaygcatayttyt

SEQ ID NO: 4517 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (11)..(11): base is a locked nucleic acid
dgaygcataytty

SEQ ID NO: 4518 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
  modified_base (13)..(13): base is a locked nucleic acid
dgaygcataytty

SEQ ID NO: 4519 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (3)..(3): base is a locked nucleic acid
  modified_base (8)..(8): base is a locked nucleic acid
  modified_base (10)..(10): base is a locked nucleic acid
dgaygcataytty

SEQ ID NO: 4520 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (2)..(2): base is a locked nucleic acid
  modified_base (8)..(8): base is a locked nucleic acid
  modified_base (10)..(10): base is a locked nucleic acid
dgaygcataytty

SEQ ID NO: 4521 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (5)..(5): base is a locked nucleic acid
  modified_base (8)..(8): base is a locked nucleic acid
  modified_base (10)..(10): base is a locked nucleic acid
dgaygcataytty

SEQ ID NO: 4522 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (7)..(7): base is a locked nucleic acid
  modified_base (8)..(8): base is a locked nucleic acid
  modified_base (10)..(10): base is a locked nucleic acid
dgaygcataytty

SEQ ID NO: 4523 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
  modified_base (8)..(8): base is a locked nucleic acid
  modified_base (10)..(10): base is a locked nucleic acid
dgaygcataytty

SEQ ID NO: 4524 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
tgaaaartatgcatc

SEQ ID NO: 4525 - DNA, 19 bp, Artificial Sequence
  Oligonucleotide probe
  misc_binding (1)..(19): Hybridization probe for the specific detection of wild-type HIV-1 at codon 115 of the reverse transcriptase gene.
gdgaygcatayttytcagt

SEQ ID NO: 4526 - DNA, 17 bp, Artificial Sequence
  Oligonucleotide probe
  misc_binding (1)..(17): Hybridization probe for the specific detection of wild-type HIV-1 at codon 115 of the reverse transcriptase gene.
dgaygcatayttytcag

SEQ ID NO: 4527 - DNA, 15 bp, Artificial Sequence
  Oligonucleotide probe
  misc_binding (1)..(15): Hybridization probe for the specific detection of wild-type HIV-1 at codon 115 of the reverse transcriptase gene.
dgaygcatayttytc

SEQ ID NO: 4528 - DNA, 13 bp, Artificial Sequence
  Oligonucleotide probe
  misc_binding (1)..(13): Hybridization probe for the specific detection of wild-type HIV-1 at codon 115 of the reverse transcriptase gene.
dgaygcataytty

SEQ ID NO: 4529 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (18)..(18): base is a locked nucleic acid
aygcatayttytcagtycc

SEQ ID NO: 4530 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (11)..(11): base is a locked nucleic acid
aygcatayttytcagtycc

SEQ ID NO: 4531 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (19)..(19): base is a locked nucleic acid
aygcatayttytcagtycc

SEQ ID NO: 4532 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (13)..(13): base is a locked nucleic acid
aygcatayttytcagtycc

SEQ ID NO: 4533 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (9)..(9): base is a locked nucleic acid
aygcatayttytcagtycc

SEQ ID NO: 4534 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (3)..(3): base is a locked nucleic acid
aygcatayttytcagtycc

SEQ ID NO: 4535 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (4)..(4): base is a locked nucleic acid
aygcatayttytcagtycc

SEQ ID NO: 4536 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (8)..(8): base is a locked nucleic acid
aygcatayttytcagtycc

SEQ ID NO: 4537 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (9)..(9): base is a locked nucleic acid
  modified_base (11)..(11): base is a locked nucleic acid
  modified_base (12)..(12): base is a locked nucleic acid
aygcatayttytcagtycc

SEQ ID NO: 4538 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (9)..(9): base is a locked nucleic acid
  modified_base (11)..(11): base is a locked nucleic acid
  modified_base (15)..(15): base is a locked nucleic acid
aygcatayttytcagtycc

SEQ ID NO: 4539 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (9)..(9): base is a locked nucleic acid
  modified_base (11)..(11): base is a locked nucleic acid
  modified_base (14)..(14): base is a locked nucleic acid
aygcatayttytcagtycc

SEQ ID NO: 4540 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (9)..(9): base is a locked nucleic acid
  modified_base (11)..(11): base is a locked nucleic acid
  modified_base (19)..(19): base is a locked nucleic acid
aygcatayttytcagtycc

SEQ ID NO: 4541 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (5)..(5): base is a locked nucleic acid
  modified_base (9)..(9): base is a locked nucleic acid
  modified_base (11)..(11): base is a locked nucleic acid
aygcatayttytcagtycc

SEQ ID NO: 4542 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (4)..(4): base is a locked nucleic acid
  modified_base (9)..(9): base is a locked nucleic acid
  modified_base (11)..(11): base is a locked nucleic acid
aygcatayttytcagtycc

SEQ ID NO: 4543 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (7)..(7): base is a locked nucleic acid
  modified_base (9)..(9): base is a locked nucleic acid
  modified_base (11)..(11): base is a locked nucleic acid
aygcatayttytcagtycc

SEQ ID NO: 4544 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (3)..(3): base is a locked nucleic acid
  modified_base (9)..(9): base is a locked nucleic acid
  modified_base (11)..(11): base is a locked nucleic acid
aygcatayttytcagtycc

SEQ ID NO: 4545 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
  modified_base (9)..(9): base is a locked nucleic acid
  modified_base (11)..(11): base is a locked nucleic acid
aygcatayttytcagtycc

SEQ ID NO: 4546 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (17)..(17): base is a locked nucleic acid
ygcatayttytcagtyc

SEQ ID NO: 4547 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (10)..(10): base is a locked nucleic acid
ygcatayttytcagtyc

SEQ ID NO: 4548 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
ygcatayttytcagtyc

SEQ ID NO: 4549 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (12)..(12): base is a locked nucleic acid
ygcatayttytcagtyc

SEQ ID NO: 4550 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (8)..(8): base is a locked nucleic acid
ygcatayttytcagtyc

SEQ ID NO: 4551 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (2)..(2): base is a locked nucleic acid
ygcatayttytcagtyc

SEQ ID NO: 4552 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (3)..(3): base is a locked nucleic acid
ygcatayttytcagtyc

SEQ ID NO: 4553 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (7)..(7): base is a locked nucleic acid
ygcatayttytcagtyc

SEQ ID NO: 4554 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (11)..(11): base is a locked nucleic acid
ygcatayttytcagtyc

SEQ ID NO: 4555 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (14)..(14): base is a locked nucleic acid
ygcatayttytcagtyc

SEQ ID NO: 4556 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (13)..(13): base is a locked nucleic acid
ygcatayttytcagtyc

SEQ ID NO: 4557 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
ygcatayttytcagtyc

SEQ ID NO: 4558 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (4)..(4): base is a locked nucleic acid
  modified_base (8)..(8): base is a locked nucleic acid
  modified_base (10)..(10): base is a locked nucleic acid
ygcatayttytcagtyc

SEQ ID NO: 4559 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (3)..(3): base is a locked nucleic acid
  modified_base (8)..(8): base is a locked nucleic acid
  modified_base (10)..(10): base is a locked nucleic acid
ygcatayttytcagtyc

SEQ ID NO: 4560 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (6)..(6): base is a locked nucleic acid
  modified_base (8)..(8): base is a locked nucleic acid
  modified_base (10)..(10): base is a locked nucleic acid
ygcatayttytcagtyc

SEQ ID NO: 4561 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (2)..(2): base is a locked nucleic acid
  modified_base (8)..(8): base is a locked nucleic acid
  modified_base (10)..(10): base is a locked nucleic acid
ygcatayttytcagtyc

SEQ ID NO: 4562 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
ygcatayttytcagtyc

SEQ ID NO: 4563 - DNA, 16 bp, Artificial Sequence
  Oligonucleotide probe
  misc_binding (1)..(16): Hybridization probe for the specific detection of wild-type HIV-1 at codon 116 of the reverse transcriptase gene.
ygcatayttytcagty

SEQ ID NO: 4564 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (10)..(10): base is a locked nucleic acid
ygcatayttytcagt

SEQ ID NO: 4565 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (12)..(12): base is a locked nucleic acid
ygcatayttytcagt

SEQ ID NO: 4566 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (8)..(8): base is a locked nucleic acid
ygcatayttytcagt

SEQ ID NO: 4567 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (2)..(2): base is a locked nucleic acid
ygcatayttytcagt

SEQ ID NO: 4568 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (3)..(3): base is a locked nucleic acid
ygcatayttytcagt

SEQ ID NO: 4569 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (7)..(7): base is a locked nucleic acid
ygcatayttytcagt

SEQ ID NO: 4570 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (11)..(11): base is a locked nucleic acid
ygcatayttytcagt

SEQ ID NO: 4571 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (14)..(14): base is a locked nucleic acid
ygcatayttytcagt

SEQ ID NO: 4572 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (13)..(13): base is a locked nucleic acid
ygcatayttytcagt

SEQ ID NO: 4573 - DNA, 16 bp, Artificial Sequence
  Oligonucleotide probe
  misc_binding (1)..(16): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
ygcatayttytcagty

SEQ ID NO: 4574 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (4)..(4): base is a locked nucleic acid
  modified_base (8)..(8): base is a locked nucleic acid
  modified_base (10)..(10): base is a locked nucleic acid
ygcatayttytcagt

SEQ ID NO: 4575 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (3)..(3): base is a locked nucleic acid
  modified_base (8)..(8): base is a locked nucleic acid
  modified_base (10)..(10): base is a locked nucleic acid
ygcatayttytcagt

SEQ ID NO: 4576 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (6)..(6): base is a locked nucleic acid
  modified_base (8)..(8): base is a locked nucleic acid
  modified_base (10)..(10): base is a locked nucleic acid
ygcatayttytcagt

SEQ ID NO: 4577 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (2)..(2): base is a locked nucleic acid
  modified_base (8)..(8): base is a locked nucleic acid
  modified_base (10)..(10): base is a locked nucleic acid
ygcatayttytcagt

SEQ ID NO: 4578 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
ygcatayttytcagt

SEQ ID NO: 4579 - DNA, 14 bp, Artificial Sequence
  Oligonucleotide probe
  misc_binding (1)..(14): Hybridization probe for the specific detection of wild-type HIV-1 at codon 116 of the reverse transcriptase gene.
ygcatayttytcag

SEQ ID NO: 4580 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (10)..(10): base is a locked nucleic acid
ygcatayttytca

SEQ ID NO: 4581 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (12)..(12): base is a locked nucleic acid
ygcatayttytca

SEQ ID NO: 4582 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (8)..(8): base is a locked nucleic acid
ygcatayttytca

SEQ ID NO: 4583 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (2)..(2): base is a locked nucleic acid
ygcatayttytca

SEQ ID NO: 4584 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (3)..(3): base is a locked nucleic acid
ygcatayttytca

SEQ ID NO: 4585 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (7)..(7): base is a locked nucleic acid
ygcatayttytca

SEQ ID NO: 4586 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (11)..(11): base is a locked nucleic acid
ygcatayttytca

SEQ ID NO: 4587 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
ygcatayttytca

SEQ ID NO: 4588 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
  modified_base (13)..(13): base is a locked nucleic acid
ygcatayttytca

SEQ ID NO: 4589 - DNA, 14 bp, Artificial Sequence
  Oligonucleotide probe
  misc_binding (1)..(14): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
ygcatayttytcag

SEQ ID NO: 4590 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (4)..(4): base is a locked nucleic acid
  modified_base (8)..(8): base is a locked nucleic acid
  modified_base (10)..(10): base is a locked nucleic acid
ygcatayttytca

SEQ ID NO: 4591 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (3)..(3): base is a locked nucleic acid
  modified_base (8)..(8): base is a locked nucleic acid
  modified_base (10)..(10): base is a locked nucleic acid
ygcatayttytca

SEQ ID NO: 4592 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (6)..(6): base is a locked nucleic acid
  modified_base (8)..(8): base is a locked nucleic acid
  modified_base (10)..(10): base is a locked nucleic acid
ygcatayttytca

SEQ ID NO: 4593 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (2)..(2): base is a locked nucleic acid
  modified_base (8)..(8): base is a locked nucleic acid
  modified_base (10)..(10): base is a locked nucleic acid
ygcatayttytca

SEQ ID NO: 4594 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
  modified_base (8)..(8): base is a locked nucleic acid
  modified_base (10)..(10): base is a locked nucleic acid
ygcatayttytca

SEQ ID NO: 4595 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
aactgaraaatatgc

SEQ ID NO: 4596 - DNA, 19 bp, Artificial Sequence
  Oligonucleotide probe
  misc_binding (1)..(19): Hybridization probe for the specific detection of wild-type HIV-1 at codon 116 of the reverse transcriptase gene.
aygcatayttytcagtycc

SEQ ID NO: 4597 - DNA, 17 bp, Artificial Sequence
  Oligonucleotide probe
  misc_binding (1)..(17): Hybridization probe for the specific detection of wild-type HIV-1 at codon 116 of the reverse transcriptase gene.
ygcatayttytcagtyc

SEQ ID NO: 4598 - DNA, 15 bp, Artificial Sequence
  Oligonucleotide probe
  misc_binding (1)..(15): Hybridization probe for the specific detection of wild-type HIV-1 at codon 116 of the reverse transcriptase gene.
ygcatayttytcagt

SEQ ID NO: 4599 - DNA, 13 bp, Artificial Sequence
  Oligonucleotide probe
  misc_binding (1)..(13): Hybridization probe for the specific detection of wild-type HIV-1 at codon 116 of the reverse transcriptase gene.
ygcatayttytca

SEQ ID NO: 4600 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (11)..(11): base is a locked nucleic acid
tayttytcagtyccyttab

SEQ ID NO: 4601 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (13)..(13): base is a locked nucleic acid
tayttytcagtyccyttab

SEQ ID NO: 4602 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (15)..(15): base is a locked nucleic acid
tayttytcagtyccyttab

SEQ ID NO: 4603 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (19)..(19): base is a locked nucleic acid
tayttytcagtyccyttab

SEQ ID NO: 4604 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (2)..(2): base is a locked nucleic acid
tayttytcagtyccyttab

SEQ ID NO: 4605 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (9)..(9): base is a locked nucleic acid
tayttytcagtyccyttab

SEQ ID NO: 4606 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (4)..(4): base is a locked nucleic acid
tayttytcagtyccyttab

SEQ ID NO: 4607 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (7)..(7): base is a locked nucleic acid
tayttytcagtyccyttab

SEQ ID NO: 4608 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (9)..(9): base is a locked nucleic acid
  modified_base (11)..(11): base is a locked nucleic acid
  modified_base (16)..(16): base is a locked nucleic acid
tayttytcagtyccyttab

SEQ ID NO: 4609 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (9)..(9): base is a locked nucleic acid
  modified_base (11)..(11): base is a locked nucleic acid
  modified_base (15)..(15): base is a locked nucleic acid
tayttytcagtyccyttab

SEQ ID NO: 4610 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (9)..(9): base is a locked nucleic acid
  modified_base (11)..(11): base is a locked nucleic acid
  modified_base (14)..(14): base is a locked nucleic acid
tayttytcagtyccyttab

SEQ ID NO: 4611 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (9)..(9): base is a locked nucleic acid
  modified_base (11)..(11): base is a locked nucleic acid
  modified_base (12)..(12): base is a locked nucleic acid
tayttytcagtyccyttab

SEQ ID NO: 4612 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (2)..(2): base is a locked nucleic acid
  modified_base (9)..(9): base is a locked nucleic acid
  modified_base (11)..(11): base is a locked nucleic acid
tayttytcagtyccyttab

SEQ ID NO: 4613 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (6)..(6): base is a locked nucleic acid
  modified_base (9)..(9): base is a locked nucleic acid
  modified_base (11)..(11): base is a locked nucleic acid
tayttytcagtyccyttab

SEQ ID NO: 4614 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (3)..(3): base is a locked nucleic acid
  modified_base (9)..(9): base is a locked nucleic acid
  modified_base (11)..(11): base is a locked nucleic acid
tayttytcagtyccyttab

SEQ ID NO: 4615 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (5)..(5): base is a locked nucleic acid
  modified_base (9)..(9): base is a locked nucleic acid
  modified_base (11)..(11): base is a locked nucleic acid
tayttytcagtyccyttab

SEQ ID NO: 4616 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
  modified_base (9)..(9): base is a locked nucleic acid
  modified_base (11)..(11): base is a locked nucleic acid
tayttytcagtyccyttab

SEQ ID NO: 4617 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (10)..(10): base is a locked nucleic acid
ayttytcagtyccytta

SEQ ID NO: 4618 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (12)..(12): base is a locked nucleic acid
ayttytcagtyccytta

SEQ ID NO: 4619 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (14)..(14): base is a locked nucleic acid
ayttytcagtyccytta

SEQ ID NO: 4620 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
ayttytcagtyccytta

SEQ ID NO: 4621 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (1)..(1): base is a locked nucleic acid
ayttytcagtyccytta

SEQ ID NO: 4622 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (8)..(8): base is a locked nucleic acid
ayttytcagtyccytta

SEQ ID NO: 4623 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (3)..(3): base is a locked nucleic acid
ayttytcagtyccytta

SEQ ID NO: 4624 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (6)..(6): base is a locked nucleic acid
ayttytcagtyccytta

SEQ ID NO: 4625 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (15)..(15): base is a locked nucleic acid
ayttytcagtyccytta

SEQ ID NO: 4626 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (14)..(14): base is a locked nucleic acid
ayttytcagtyccytta

SEQ ID NO: 4627 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (13)..(13): base is a locked nucleic acid
ayttytcagtyccytta

SEQ ID NO: 4628 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (11)..(11): base is a locked nucleic acid
ayttytcagtyccytta

SEQ ID NO: 4629 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (1)..(1): base is a locked nucleic acid
  modified_base (8)..(8): base is a locked nucleic acid
  modified_base (10)..(10): base is a locked nucleic acid
ayttytcagtyccytta

SEQ ID NO: 4630 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (5)..(5): base is a locked nucleic acid
  modified_base (8)..(8): base is a locked nucleic acid
  modified_base (10)..(10): base is a locked nucleic acid
ayttytcagtyccytta

SEQ ID NO: 4631 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (2)..(2): base is a locked nucleic acid
  modified_base (8)..(8): base is a locked nucleic acid
  modified_base (10)..(10): base is a locked nucleic acid
ayttytcagtyccytta

SEQ ID NO: 4632 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (4)..(4): base is a locked nucleic acid
  modified_base (8)..(8): base is a locked nucleic acid
  modified_base (10)..(10): base is a locked nucleic acid
ayttytcagtyccytta

SEQ ID NO: 4633 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
ayttytcagtyccytta

SEQ ID NO: 4634 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (10)..(10): base is a locked nucleic acid
ayttytcagtyccyt

SEQ ID NO: 4635 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (12)..(12): base is a locked nucleic acid
ayttytcagtyccyt

SEQ ID NO: 4636 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (14)..(14): base is a locked nucleic acid
ayttytcagtyccyt

SEQ ID NO: 4637 - DNA, 16 bp, Artificial Sequence
  Oligonucleotide probe
  misc_binding (1)..(16): Hybridization probe for the specific detection of wild-type HIV-1 at codon 118 of the reverse transcriptase gene.
ayttytcagtyccytt

SEQ ID NO: 4638 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (1)..(1): base is a locked nucleic acid
ayttytcagtyccyt

SEQ ID NO: 4639 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (8)..(8): base is a locked nucleic acid
ayttytcagtyccyt

SEQ ID NO: 4640 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (3)..(3): base is a locked nucleic acid
ayttytcagtyccyt

SEQ ID NO: 4641 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (6)..(6): base is a locked nucleic acid
ayttytcagtyccyt

SEQ ID NO: 4642 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (15)..(15): base is a locked nucleic acid
ayttytcagtyccyt

SEQ ID NO: 4643 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (14)..(14): base is a locked nucleic acid
ayttytcagtyccyt

SEQ ID NO: 4644 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (13)..(13): base is a locked nucleic acid
ayttytcagtyccyt

SEQ ID NO: 4645 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (11)..(11): base is a locked nucleic acid
ayttytcagtyccyt

SEQ ID NO: 4646 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (1)..(1): base is a locked nucleic acid
  modified_base (8)..(8): base is a locked nucleic acid
  modified_base (10)..(10): base is a locked nucleic acid
ayttytcagtyccyt

SEQ ID NO: 4647 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (5)..(5): base is a locked nucleic acid
  modified_base (8)..(8): base is a locked nucleic acid
  modified_base (10)..(10): base is a locked nucleic acid
ayttytcagtyccyt

SEQ ID NO: 4648 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (2)..(2): base is a locked nucleic acid
  modified_base (8)..(8): base is a locked nucleic acid
  modified_base (10)..(10): base is a locked nucleic acid
ayttytcagtyccyt

SEQ ID NO: 4649 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (4)..(4): base is a locked nucleic acid
  modified_base (8)..(8): base is a locked nucleic acid
  modified_base (10)..(10): base is a locked nucleic acid
ayttytcagtyccyt

SEQ ID NO: 4650 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
ayttytcagtyccyt

SEQ ID NO: 4651 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (10)..(10): base is a locked nucleic acid
ayttytcagtycc

SEQ ID NO: 4652 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (12)..(12): base is a locked nucleic acid
ayttytcagtycc

SEQ ID NO: 4653 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
ayttytcagtycc

SEQ ID NO: 4654 - DNA, 14 bp, Artificial Sequence
  Oligonucleotide probe
  misc_binding (1)..(14): Hybridization probe for the specific detection of wild-type HIV-1 at codon 118 of the reverse transcriptase gene.
ayttytcagtyccy

SEQ ID NO: 4655 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (1)..(1): base is a locked nucleic acid
ayttytcagtycc

SEQ ID NO: 4656 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (8)..(8): base is a locked nucleic acid
ayttytcagtycc

SEQ ID NO: 4657 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (3)..(3): base is a locked nucleic acid
ayttytcagtycc

SEQ ID NO: 4658 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (6)..(6): base is a locked nucleic acid
ayttytcagtycc

SEQ ID NO: 4659 - DNA, 14 bp, Artificial Sequence
  Oligonucleotide probe
  misc_binding (1)..(14): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
ayttytcagtyccy

SEQ ID NO: 4660 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
ayttytcagtycc

SEQ ID NO: 4661 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (13)..(13): base is a locked nucleic acid
ayttytcagtycc

SEQ ID NO: 4662 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
  modified_base (11)..(11): base is a locked nucleic acid
ayttytcagtycc

SEQ ID NO: 4663 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (1)..(1): base is a locked nucleic acid
  modified_base (8)..(8): base is a locked nucleic acid
  modified_base (10)..(10): base is a locked nucleic acid
ayttytcagtycc

SEQ ID NO: 4664 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (5)..(5): base is a locked nucleic acid
  modified_base (8)..(8): base is a locked nucleic acid
  modified_base (10)..(10): base is a locked nucleic acid
ayttytcagtycc

SEQ ID NO: 4665 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (2)..(2): base is a locked nucleic acid
  modified_base (8)..(8): base is a locked nucleic acid
  modified_base (10)..(10): base is a locked nucleic acid
ayttytcagtycc

SEQ ID NO: 4666 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (4)..(4): base is a locked nucleic acid
  modified_base (8)..(8): base is a locked nucleic acid
  modified_base (10)..(10): base is a locked nucleic acid
ayttytcagtycc

SEQ ID NO: 4667 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
  modified_base (8)..(8): base is a locked nucleic acid
  modified_base (10)..(10): base is a locked nucleic acid
ayttytcagtycc

SEQ ID NO: 4668 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
  misc_feature (10)..(10): n is a, c, g, or t
tttttcagtnccttt

SEQ ID NO: 4669 - DNA, 19 bp, Artificial Sequence
  Oligonucleotide probe
  misc_binding (1)..(19): Hybridization probe for the specific detection of wild-type HIV-1 at codon 118 of the reverse transcriptase gene.
tayttytcagtyccyttab

SEQ ID NO: 4670 - DNA, 17 bp, Artificial Sequence
  Oligonucleotide probe
  misc_binding (1)..(17): Hybridization probe for the specific detection of wild-type HIV-1 at codon 118 of the reverse transcriptase gene.
ayttytcagtyccytta

SEQ ID NO: 4671 - DNA, 15 bp, Artificial Sequence
  Oligonucleotide probe
  misc_binding (1)..(15): Hybridization probe for the specific detection of wild-type HIV-1 at codon 118 of the reverse transcriptase gene.
ayttytcagtyccyt

SEQ ID NO: 4672 - DNA, 13 bp, Artificial Sequence
  Oligonucleotide probe
  misc_binding (1)..(13): Hybridization probe for the specific detection of wild-type HIV-1 at codon 118 of the reverse transcriptase gene.
ayttytcagtycc

SEQ ID NO: 4673 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (12)..(12): base is a locked nucleic acid
ryaaayaatgaracaccag

SEQ ID NO: 4674 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (13)..(13): base is a locked nucleic acid
yaaayaatgaracaccagg

SEQ ID NO: 4675 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (16)..(16): base is a locked nucleic acid
yaaayaatgaracaccagg

SEQ ID NO: 4676 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (15)..(15): base is a locked nucleic acid
ryaaayaatgaracaccag

SEQ ID NO: 4677 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (14)..(14): base is a locked nucleic acid
ryaaayaatgaracaccag

SEQ ID NO: 4678 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (15)..(15): base is a locked nucleic acid
yaaayaatgaracaccagg

SEQ ID NO: 4679 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (14)..(14): base is a locked nucleic acid
yaaayaatgaracaccagg

SEQ ID NO: 4680 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (16)..(16): base is a locked nucleic acid
ryaaayaatgaracaccag

SEQ ID NO: 4681 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (18)..(18): base is a locked nucleic acid
ryaaayaatgaracaccag

SEQ ID NO: 4682 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (17)..(17): base is a locked nucleic acid
yaaayaatgaracaccagg

SEQ ID NO: 4683 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (11)..(11): base is a locked nucleic acid
ryaaayaatgaracaccag

SEQ ID NO: 4684 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (19)..(19): base is a locked nucleic acid
yaaayaatgaracaccagg

SEQ ID NO: 4685 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (17)..(17): base is a locked nucleic acid
ryaaayaatgaracaccag

SEQ ID NO: 4686 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
ryaaayaatgaracaccag

SEQ ID NO: 4687 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (3)..(3): base is a locked nucleic acid
yaaayaatgaracaccagg

SEQ ID NO: 4688 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (4)..(4): base is a locked nucleic acid
yaaayaatgaracaccagg

SEQ ID NO: 4689 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (4)..(4): base is a locked nucleic acid
ryaaayaatgaracaccag

SEQ ID NO: 4690 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (8)..(8): base is a locked nucleic acid
ryaaayaatgaracaccag

SEQ ID NO: 4691 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
yaaayaatgaracaccagg

SEQ ID NO: 4692 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (5)..(5): base is a locked nucleic acid
ryaaayaatgaracaccag

SEQ ID NO: 4693 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (5)..(5): base is a locked nucleic acid
yaaayaatgaracaccagg

SEQ ID NO: 4694 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (6)..(6): base is a locked nucleic acid
ryaaayaatgaracaccag

SEQ ID NO: 4695 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (2)..(2): base is a locked nucleic acid
yaaayaatgaracaccagg

SEQ ID NO: 4696 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (17)..(17): base is a locked nucleic acid
ryaaayaatgaracaccag

SEQ ID NO: 4697 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (13)..(13): base is a locked nucleic acid
yaaayaatgaracaccagg

SEQ ID NO: 4698 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (19)..(19): base is a locked nucleic acid
yaaayaatgaracaccagg

SEQ ID NO: 4699 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (16)..(16): base is a locked nucleic acid
ryaaayaatgaracaccag

SEQ ID NO: 4700 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (15)..(15): base is a locked nucleic acid
yaaayaatgaracaccagg

SEQ ID NO: 4701 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (15)..(15): base is a locked nucleic acid
ryaaayaatgaracaccag

SEQ ID NO: 4702 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (12)..(12): base is a locked nucleic acid
ryaaayaatgaracaccag

SEQ ID NO: 4703 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (12)..(12): base is a locked nucleic acid
yaaayaatgaracaccagg

SEQ ID NO: 4704 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (14)..(14): base is a locked nucleic acid
ryaaayaatgaracaccag

SEQ ID NO: 4705 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (16)..(16): base is a locked nucleic acid
yaaayaatgaracaccagg

SEQ ID NO: 4706 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
  modified_base (18)..(18): base is a locked nucleic acid
ryaaayaatgaracaccag

SEQ ID NO: 4707 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (2)..(2): base is a locked nucleic acid
  modified_base (9)..(9): base is a locked nucleic acid
  modified_base (11)..(11): base is a locked nucleic acid
ryaaayaatgaracaccag

SEQ ID NO: 4708 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (6)..(6): base is a locked nucleic acid
  modified_base (9)..(9): base is a locked nucleic acid
  modified_base (11)..(11): base is a locked nucleic acid
yaaayaatgaracaccagg

SEQ ID NO: 4709 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (6)..(6): base is a locked nucleic acid
  modified_base (9)..(9): base is a locked nucleic acid
  modified_base (11)..(11): base is a locked nucleic acid
ryaaayaatgaracaccag

SEQ ID NO: 4710 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (7)..(7): base is a locked nucleic acid
  modified_base (9)..(9): base is a locked nucleic acid
  modified_base (11)..(11): base is a locked nucleic acid
ryaaayaatgaracaccag

SEQ ID NO: 4711 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (8)..(8): base is a locked nucleic acid
  modified_base (9)..(9): base is a locked nucleic acid
  modified_base (11)..(11): base is a locked nucleic acid
yaaayaatgaracaccagg

SEQ ID NO: 4712 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (3)..(3): base is a locked nucleic acid
  modified_base (9)..(9): base is a locked nucleic acid
  modified_base (11)..(11): base is a locked nucleic acid
ryaaayaatgaracaccag

SEQ ID NO: 4713 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (3)..(3): base is a locked nucleic acid
  modified_base (9)..(9): base is a locked nucleic acid
  modified_base (11)..(11): base is a locked nucleic acid
yaaayaatgaracaccagg

SEQ ID NO: 4714 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (4)..(4): base is a locked nucleic acid
  modified_base (9)..(9): base is a locked nucleic acid
  modified_base (11)..(11): base is a locked nucleic acid
yaaayaatgaracaccagg

SEQ ID NO: 4715 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (8)..(8): base is a locked nucleic acid
  modified_base (9)..(9): base is a locked nucleic acid
  modified_base (11)..(11): base is a locked nucleic acid
ryaaayaatgaracaccag

SEQ ID NO: 4716 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (7)..(7): base is a locked nucleic acid
  modified_base (9)..(9): base is a locked nucleic acid
  modified_base (11)..(11): base is a locked nucleic acid
yaaayaatgaracaccagg

SEQ ID NO: 4717 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (5)..(5): base is a locked nucleic acid
  modified_base (9)..(9): base is a locked nucleic acid
  modified_base (11)..(11): base is a locked nucleic acid
ryaaayaatgaracaccag

SEQ ID NO: 4718 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
ryaaayaatgaracaccag

SEQ ID NO: 4719 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
  modified_base (9)..(9): base is a locked nucleic acid
  modified_base (11)..(11): base is a locked nucleic acid
yaaayaatgaracaccagg

SEQ ID NO: 4720 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (11)..(11): base is a locked nucleic acid
yaaayaatgaracacca

SEQ ID NO: 4721 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (12)..(12): base is a locked nucleic acid
aaayaatgaracaccag

SEQ ID NO: 4722 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (15)..(15): base is a locked nucleic acid
aaayaatgaracaccag

SEQ ID NO: 4723 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (14)..(14): base is a locked nucleic acid
yaaayaatgaracacca

SEQ ID NO: 4724 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (13)..(13): base is a locked nucleic acid
yaaayaatgaracacca

SEQ ID NO: 4725 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (14)..(14): base is a locked nucleic acid
aaayaatgaracaccag

SEQ ID NO: 4726 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (13)..(13): base is a locked nucleic acid
aaayaatgaracaccag

SEQ ID NO: 4727 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (15)..(15): base is a locked nucleic acid
yaaayaatgaracacca

SEQ ID NO: 4728 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (17)..(17): base is a locked nucleic acid
yaaayaatgaracacca

SEQ ID NO: 4729 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (16)..(16): base is a locked nucleic acid
aaayaatgaracaccag

SEQ ID NO: 4730 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (10)..(10): base is a locked nucleic acid
yaaayaatgaracacca

SEQ ID NO: 4731 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
aaayaatgaracaccag

SEQ ID NO: 4732 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (16)..(16): base is a locked nucleic acid
yaaayaatgaracacca

SEQ ID NO: 4733 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
yaaayaatgaracacca

SEQ ID NO: 4734 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (2)..(2): base is a locked nucleic acid
aaayaatgaracaccag

SEQ ID NO: 4735 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (3)..(3): base is a locked nucleic acid
aaayaatgaracaccag

SEQ ID NO: 4736 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (3)..(3): base is a locked nucleic acid
yaaayaatgaracacca

SEQ ID NO: 4737 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (7)..(7): base is a locked nucleic acid
yaaayaatgaracacca

SEQ ID NO: 4738 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
aaayaatgaracaccag

SEQ ID NO: 4739 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (4)..(4): base is a locked nucleic acid
yaaayaatgaracacca

SEQ ID NO: 4740 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (4)..(4): base is a locked nucleic acid
aaayaatgaracaccag

SEQ ID NO: 4741 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (5)..(5): base is a locked nucleic acid
yaaayaatgaracacca

SEQ ID NO: 4742 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (1)..(1): base is a locked nucleic acid
aaayaatgaracaccag

SEQ ID NO: 4743 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (16)..(16): base is a locked nucleic acid
yaaayaatgaracacca

SEQ ID NO: 4744 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (12)..(12): base is a locked nucleic acid
aaayaatgaracaccag

SEQ ID NO: 4745 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
aaayaatgaracaccag

SEQ ID NO: 4746 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (15)..(15): base is a locked nucleic acid
yaaayaatgaracacca

SEQ ID NO: 4747 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (14)..(14): base is a locked nucleic acid
aaayaatgaracaccag

SEQ ID NO: 4748 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (14)..(14): base is a locked nucleic acid
yaaayaatgaracacca

SEQ ID NO: 4749 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (11)..(11): base is a locked nucleic acid
yaaayaatgaracacca

SEQ ID NO: 4750 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (11)..(11): base is a locked nucleic acid
aaayaatgaracaccag

SEQ ID NO: 4751 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (13)..(13): base is a locked nucleic acid
yaaayaatgaracacca

SEQ ID NO: 4752 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (15)..(15): base is a locked nucleic acid
aaayaatgaracaccag

SEQ ID NO: 4753 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (17)..(17): base is a locked nucleic acid
yaaayaatgaracacca

SEQ ID NO: 4754 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (1)..(1): base is a locked nucleic acid
  modified_base (8)..(8): base is a locked nucleic acid
  modified_base (10)..(10): base is a locked nucleic acid
yaaayaatgaracacca

SEQ ID NO: 4755 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (5)..(5): base is a locked nucleic acid
  modified_base (8)..(8): base is a locked nucleic acid
  modified_base (10)..(10): base is a locked nucleic acid
aaayaatgaracaccag

SEQ ID NO: 4756 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (5)..(5): base is a locked nucleic acid
  modified_base (8)..(8): base is a locked nucleic acid
  modified_base (10)..(10): base is a locked nucleic acid
yaaayaatgaracacca

SEQ ID NO: 4757 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (6)..(6): base is a locked nucleic acid
  modified_base (8)..(8): base is a locked nucleic acid
  modified_base (10)..(10): base is a locked nucleic acid
yaaayaatgaracacca

SEQ ID NO: 4758 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (7)..(7): base is a locked nucleic acid
  modified_base (8)..(8): base is a locked nucleic acid
  modified_base (10)..(10): base is a locked nucleic acid
aaayaatgaracaccag

SEQ ID NO: 4759 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (2)..(2): base is a locked nucleic acid
  modified_base (8)..(8): base is a locked nucleic acid
  modified_base (10)..(10): base is a locked nucleic acid
yaaayaatgaracacca

SEQ ID NO: 4760 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (2)..(2): base is a locked nucleic acid
  modified_base (8)..(8): base is a locked nucleic acid
  modified_base (10)..(10): base is a locked nucleic acid
aaayaatgaracaccag

SEQ ID NO: 4761 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (3)..(3): base is a locked nucleic acid
  modified_base (8)..(8): base is a locked nucleic acid
  modified_base (10)..(10): base is a locked nucleic acid
aaayaatgaracaccag

SEQ ID NO: 4762 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (7)..(7): base is a locked nucleic acid
  modified_base (8)..(8): base is a locked nucleic acid
  modified_base (10)..(10): base is a locked nucleic acid
yaaayaatgaracacca

SEQ ID NO: 4763 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (6)..(6): base is a locked nucleic acid
  modified_base (8)..(8): base is a locked nucleic acid
  modified_base (10)..(10): base is a locked nucleic acid
aaayaatgaracaccag

SEQ ID NO: 4764 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (4)..(4): base is a locked nucleic acid
  modified_base (8)..(8): base is a locked nucleic acid
  modified_base (10)..(10): base is a locked nucleic acid
yaaayaatgaracacca

SEQ ID NO: 4765 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
yaaayaatgaracacca

SEQ ID NO: 4766 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
aaayaatgaracaccag

SEQ ID NO: 4767 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (11)..(11): base is a locked nucleic acid
yaaayaatgaracac

SEQ ID NO: 4768 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (12)..(12): base is a locked nucleic acid
aaayaatgaracacc

SEQ ID NO: 4769 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (15)..(15): base is a locked nucleic acid
aaayaatgaracacc

SEQ ID NO: 4770 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (14)..(14): base is a locked nucleic acid
yaaayaatgaracac

SEQ ID NO: 4771 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (13)..(13): base is a locked nucleic acid
yaaayaatgaracac

SEQ ID NO: 4772 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (14)..(14): base is a locked nucleic acid
aaayaatgaracacc

SEQ ID NO: 4773 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (13)..(13): base is a locked nucleic acid
aaayaatgaracacc

SEQ ID NO: 4774 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (15)..(15): base is a locked nucleic acid
yaaayaatgaracac

SEQ ID NO: 4775 - DNA, 16 bp, Artificial Sequence
  Oligonucleotide probe
  misc_binding (1)..(16): Hybridization probe for the specific detection of wild-type HIV-1 at codon 138 of the reverse transcriptase gene.
yaaayaatgaracacc

SEQ ID NO: 4776 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
aaayaatgaracacc

SEQ ID NO: 4777 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (10)..(10): base is a locked nucleic acid
yaaayaatgaracac

SEQ ID NO: 4778 - DNA, 16 bp, Artificial Sequence
  Oligonucleotide probe
  misc_binding (1)..(16): Hybridization probe for the specific detection of wild-type HIV-1 at codon 138 of the reverse transcriptase gene.
aaayaatgaracacca

SEQ ID NO: 4779 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
yaaayaatgaracac

SEQ ID NO: 4780 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
yaaayaatgaracac

SEQ ID NO: 4781 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (2)..(2): base is a locked nucleic acid
aaayaatgaracacc

SEQ ID NO: 4782 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (3)..(3): base is a locked nucleic acid
aaayaatgaracacc

SEQ ID NO: 4783 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (3)..(3): base is a locked nucleic acid
yaaayaatgaracac

SEQ ID NO: 4784 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (7)..(7): base is a locked nucleic acid
yaaayaatgaracac

SEQ ID NO: 4785 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
aaayaatgaracacc

SEQ ID NO: 4786 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (4)..(4): base is a locked nucleic acid
yaaayaatgaracac

SEQ ID NO: 4787 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (4)..(4): base is a locked nucleic acid
aaayaatgaracacc

SEQ ID NO: 4788 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (5)..(5): base is a locked nucleic acid
yaaayaatgaracac

SEQ ID NO: 4789 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (1)..(1): base is a locked nucleic acid
aaayaatgaracacc

SEQ ID NO: 4790 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
yaaayaatgaracac

SEQ ID NO: 4791 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (12)..(12): base is a locked nucleic acid
aaayaatgaracacc

SEQ ID NO: 4792 - DNA, 16 bp, Artificial Sequence
  Oligonucleotide probe
  misc_binding (1)..(16): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
aaayaatgaracacca

SEQ ID NO: 4793 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (15)..(15): base is a locked nucleic acid
yaaayaatgaracac

SEQ ID NO: 4794 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (14)..(14): base is a locked nucleic acid
aaayaatgaracacc

SEQ ID NO: 4795 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (14)..(14): base is a locked nucleic acid
yaaayaatgaracac

SEQ ID NO: 4796 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (11)..(11): base is a locked nucleic acid
yaaayaatgaracac

SEQ ID NO: 4797 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (11)..(11): base is a locked nucleic acid
aaayaatgaracacc

SEQ ID NO: 4798 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (13)..(13): base is a locked nucleic acid
yaaayaatgaracac

SEQ ID NO: 4799 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (15)..(15): base is a locked nucleic acid
aaayaatgaracacc

SEQ ID NO: 4800 - DNA, 16 bp, Artificial Sequence
  Oligonucleotide probe
  misc_binding (1)..(16): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
yaaayaatgaracacc

SEQ ID NO: 4801 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (1)..(1): base is a locked nucleic acid
  modified_base (8)..(8): base is a locked nucleic acid
  modified_base (10)..(10): base is a locked nucleic acid
yaaayaatgaracac

SEQ ID NO: 4802 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (5)..(5): base is a locked nucleic acid
  modified_base (8)..(8): base is a locked nucleic acid
  modified_base (10)..(10): base is a locked nucleic acid
aaayaatgaracacc

SEQ ID NO: 4803 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (5)..(5): base is a locked nucleic acid
  modified_base (8)..(8): base is a locked nucleic acid
  modified_base (10)..(10): base is a locked nucleic acid
yaaayaatgaracac

SEQ ID NO: 4804 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (6)..(6): base is a locked nucleic acid
  modified_base (8)..(8): base is a locked nucleic acid
  modified_base (10)..(10): base is a locked nucleic acid
yaaayaatgaracac

SEQ ID NO: 4805 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (7)..(7): base is a locked nucleic acid
  modified_base (8)..(8): base is a locked nucleic acid
  modified_base (10)..(10): base is a locked nucleic acid
aaayaatgaracacc

SEQ ID NO: 4806 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (2)..(2): base is a locked nucleic acid
  modified_base (8)..(8): base is a locked nucleic acid
  modified_base (10)..(10): base is a locked nucleic acid
yaaayaatgaracac

SEQ ID NO: 4807 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (2)..(2): base is a locked nucleic acid
  modified_base (8)..(8): base is a locked nucleic acid
  modified_base (10)..(10): base is a locked nucleic acid
aaayaatgaracacc

SEQ ID NO: 4808 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (3)..(3): base is a locked nucleic acid
  modified_base (8)..(8): base is a locked nucleic acid
  modified_base (10)..(10): base is a locked nucleic acid
aaayaatgaracacc

SEQ ID NO: 4809 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (7)..(7): base is a locked nucleic acid
  modified_base (8)..(8): base is a locked nucleic acid
  modified_base (10)..(10): base is a locked nucleic acid
yaaayaatgaracac

SEQ ID NO: 4810 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (6)..(6): base is a locked nucleic acid
  modified_base (8)..(8): base is a locked nucleic acid
  modified_base (10)..(10): base is a locked nucleic acid
aaayaatgaracacc

SEQ ID NO: 4811 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (4)..(4): base is a locked nucleic acid
  modified_base (8)..(8): base is a locked nucleic acid
  modified_base (10)..(10): base is a locked nucleic acid
yaaayaatgaracac

SEQ ID NO: 4812 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
yaaayaatgaracac

SEQ ID NO: 4813 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
aaayaatgaracacc

SEQ ID NO: 4814 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (11)..(11): base is a locked nucleic acid
yaaayaatgarac

SEQ ID NO: 4815 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (12)..(12): base is a locked nucleic acid
aaayaatgaraca

SEQ ID NO: 4816 - DNA, 14 bp, Artificial Sequence
  Oligonucleotide probe
  misc_binding (1)..(14): Hybridization probe for the specific detection of wild-type HIV-1 at codon 138 of the reverse transcriptase gene.
aaayaatgaracac

SEQ ID NO: 4817 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
yaaayaatgarac

SEQ ID NO: 4818 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (13)..(13): base is a locked nucleic acid
yaaayaatgarac

SEQ ID NO: 4819 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
aaayaatgaraca

SEQ ID NO: 4820 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (13)..(13): base is a locked nucleic acid
aaayaatgaraca

SEQ ID NO: 4821 - DNA, 14 bp, Artificial Sequence
  Oligonucleotide probe
  misc_binding (1)..(14): Hybridization probe for the specific detection of wild-type HIV-1 at codon 138 of the reverse transcriptase gene.
yaaayaatgaraca

SEQ ID NO: 4822 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (10)..(10): base is a locked nucleic acid
yaaayaatgarac

SEQ ID NO: 4823 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
yaaayaatgarac

SEQ ID NO: 4824 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (2)..(2): base is a locked nucleic acid
aaayaatgaraca

SEQ ID NO: 4825 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (3)..(3): base is a locked nucleic acid
aaayaatgaraca

SEQ ID NO: 4826 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (3)..(3): base is a locked nucleic acid
yaaayaatgarac

SEQ ID NO: 4827 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (7)..(7): base is a locked nucleic acid
yaaayaatgarac

SEQ ID NO: 4828 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
aaayaatgaraca

SEQ ID NO: 4829 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (4)..(4): base is a locked nucleic acid
yaaayaatgarac

SEQ ID NO: 4830 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (4)..(4): base is a locked nucleic acid
aaayaatgaraca

SEQ ID NO: 4831 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (5)..(5): base is a locked nucleic acid
yaaayaatgarac

SEQ ID NO: 4832 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (1)..(1): base is a locked nucleic acid
aaayaatgaraca

SEQ ID NO: 4833 - DNA, 14 bp, Artificial Sequence
  Oligonucleotide probe
  misc_binding (1)..(14): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
yaaayaatgaraca

SEQ ID NO: 4834 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (12)..(12): base is a locked nucleic acid
aaayaatgaraca

SEQ ID NO: 4835 - DNA, 14 bp, Artificial Sequence
  Oligonucleotide probe
  misc_binding (1)..(14): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
aaayaatgaracac

SEQ ID NO: 4836 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
aaayaatgaraca

SEQ ID NO: 4837 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
yaaayaatgarac

SEQ ID NO: 4838 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (11)..(11): base is a locked nucleic acid
yaaayaatgarac

SEQ ID NO: 4839 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (11)..(11): base is a locked nucleic acid
aaayaatgaraca

SEQ ID NO: 4840 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
  modified_base (13)..(13): base is a locked nucleic acid
yaaayaatgarac

SEQ ID NO: 4841 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (1)..(1): base is a locked nucleic acid
  modified_base (8)..(8): base is a locked nucleic acid
  modified_base (10)..(10): base is a locked nucleic acid
yaaayaatgarac

SEQ ID NO: 4842 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (5)..(5): base is a locked nucleic acid
  modified_base (8)..(8): base is a locked nucleic acid
  modified_base (10)..(10): base is a locked nucleic acid
aaayaatgaraca

SEQ ID NO: 4843 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (5)..(5): base is a locked nucleic acid
  modified_base (8)..(8): base is a locked nucleic acid
  modified_base (10)..(10): base is a locked nucleic acid
yaaayaatgarac

SEQ ID NO: 4844 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (6)..(6): base is a locked nucleic acid
  modified_base (8)..(8): base is a locked nucleic acid
  modified_base (10)..(10): base is a locked nucleic acid
yaaayaatgarac

SEQ ID NO: 4845 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (7)..(7): base is a locked nucleic acid
  modified_base (8)..(8): base is a locked nucleic acid
  modified_base (10)..(10): base is a locked nucleic acid
aaayaatgaraca

SEQ ID NO: 4846 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (2)..(2): base is a locked nucleic acid
  modified_base (8)..(8): base is a locked nucleic acid
  modified_base (10)..(10): base is a locked nucleic acid
yaaayaatgarac

SEQ ID NO: 4847 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (2)..(2): base is a locked nucleic acid
  modified_base (8)..(8): base is a locked nucleic acid
  modified_base (10)..(10): base is a locked nucleic acid
aaayaatgaraca

SEQ ID NO: 4848 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (3)..(3): base is a locked nucleic acid
  modified_base (8)..(8): base is a locked nucleic acid
  modified_base (10)..(10): base is a locked nucleic acid
aaayaatgaraca

SEQ ID NO: 4849 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (7)..(7): base is a locked nucleic acid
  modified_base (8)..(8): base is a locked nucleic acid
  modified_base (10)..(10): base is a locked nucleic acid
yaaayaatgarac

SEQ ID NO: 4850 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (6)..(6): base is a locked nucleic acid
  modified_base (8)..(8): base is a locked nucleic acid
  modified_base (10)..(10): base is a locked nucleic acid
aaayaatgaraca

SEQ ID NO: 4851 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (4)..(4): base is a locked nucleic acid
  modified_base (8)..(8): base is a locked nucleic acid
  modified_base (10)..(10): base is a locked nucleic acid
yaaayaatgarac

SEQ ID NO: 4852 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
yaaayaatgarac

SEQ ID NO: 4853 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
  modified_base (8)..(8): base is a locked nucleic acid
  modified_base (10)..(10): base is a locked nucleic acid
aaayaatgaraca

SEQ ID NO: 4854 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
aacaatgaracacca

SEQ ID NO: 4855 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
ryaaayaatgaracaccag

SEQ ID NO: 4856 - DNA, 19 bp, Artificial Sequence
  Oligonucleotide probe
  misc_binding (1)..(19): Hybridization probe for the specific detection of wild-type HIV-1 at codon 138 of the reverse transcriptase gene.
yaaayaatgaracaccagg

SEQ ID NO: 4857 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
yaaayaatgaracacca

SEQ ID NO: 4858 - DNA, 17 bp, Artificial Sequence
  Oligonucleotide probe
  misc_binding (1)..(17): Hybridization probe for the specific detection of wild-type HIV-1 at codon 138 of the reverse transcriptase gene.
aaayaatgaracaccag

SEQ ID NO: 4859 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
yaaayaatgaracac

SEQ ID NO: 4860 - DNA, 15 bp, Artificial Sequence
  Oligonucleotide probe
  misc_binding (1)..(15): Hybridization probe for the specific detection of wild-type HIV-1 at codon 138 of the reverse transcriptase gene.
aaayaatgaracacc

SEQ ID NO: 4861 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
yaaayaatgarac

SEQ ID NO: 4862 - DNA, 13 bp, Artificial Sequence
  Oligonucleotide probe
  misc_binding (1)..(13): Hybridization probe for the specific detection of wild-type HIV-1 at codon 138 of the reverse transcriptase gene.
aaayaatgaraca

SEQ ID NO: 4863 - DNA, 15 bp, Artificial Sequence
  Oligonucleotide probe
  misc_binding (1)..(15): Hybridization probe for the specific detection of wild-type HIV-1 at codon 151 of the reverse transcriptase gene.
cttccacarggatgg

SEQ ID NO: 4864 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (13)..(13): base is a locked nucleic acid
cagavatrrtbatytayca

SEQ ID NO: 4865 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (13)..(13): base is a locked nucleic acid
ccagavatrgtbatytayc

SEQ ID NO: 4866 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (11)..(11): base is a locked nucleic acid
cagavatrrtbatytayca

SEQ ID NO: 4867 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (19)..(19): base is a locked nucleic acid
ccagavatrgtbatytayc

SEQ ID NO: 4868 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (14)..(14): base is a locked nucleic acid
cagavatrrtbatytayca

SEQ ID NO: 4869 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (18)..(18): base is a locked nucleic acid
ccagavatrgtbatytayc

SEQ ID NO: 4870 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (17)..(17): base is a locked nucleic acid
cagavatrrtbatytayca

SEQ ID NO: 4871 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (17)..(17): base is a locked nucleic acid
ccagavatrgtbatytayc

SEQ ID NO: 4872 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (8)..(8): base is a locked nucleic acid
cagavatrrtbatytayca

SEQ ID NO: 4873 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (6)..(6): base is a locked nucleic acid
ccagavatrgtbatytayc

SEQ ID NO: 4874 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
cagavatrrtbatytayca

SEQ ID NO: 4875 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (7)..(7): base is a locked nucleic acid
ccagavatrgtbatytayc

SEQ ID NO: 4876 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (6)..(6): base is a locked nucleic acid
cagavatrrtbatytayca

SEQ ID NO: 4877 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (4)..(4): base is a locked nucleic acid
ccagavatrgtbatytayc

SEQ ID NO: 4878 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (4)..(4): base is a locked nucleic acid
cagavatrrtbatytayca

SEQ ID NO: 4879 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (8)..(8): base is a locked nucleic acid
ccagavatrgtbatytayc

SEQ ID NO: 4880 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (19)..(19): base is a locked nucleic acid
cagavatrrtbatytayca

SEQ ID NO: 4881 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (18)..(18): base is a locked nucleic acid
ccagavatrgtbatytayc

SEQ ID NO: 4882 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (17)..(17): base is a locked nucleic acid
cagavatrrtbatytayca

SEQ ID NO: 4883 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (13)..(13): base is a locked nucleic acid
ccagavatrgtbatytayc

SEQ ID NO: 4884 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (16)..(16): base is a locked nucleic acid
cagavatrrtbatytayca

SEQ ID NO: 4885 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (12)..(12): base is a locked nucleic acid
ccagavatrgtbatytayc

SEQ ID NO: 4886 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (13)..(13): base is a locked nucleic acid
cagavatrrtbatytayca

SEQ ID NO: 4887 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
  modified_base (15)..(15): base is a locked nucleic acid
ccagavatrgtbatytayc

SEQ ID NO: 4888 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (5)..(5): base is a locked nucleic acid
  modified_base (9)..(9): base is a locked nucleic acid
  modified_base (11)..(11): base is a locked nucleic acid
cagavatrrtbatytayca

SEQ ID NO: 4889 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (4)..(4): base is a locked nucleic acid
  modified_base (9)..(9): base is a locked nucleic acid
  modified_base (11)..(11): base is a locked nucleic acid
ccagavatrgtbatytayc

SEQ ID NO: 4890 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (3)..(3): base is a locked nucleic acid
  modified_base (9)..(9): base is a locked nucleic acid
  modified_base (11)..(11): base is a locked nucleic acid
cagavatrrtbatytayca

SEQ ID NO: 4891 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (5)..(5): base is a locked nucleic acid
  modified_base (9)..(9): base is a locked nucleic acid
  modified_base (11)..(11): base is a locked nucleic acid
ccagavatrgtbatytayc

SEQ ID NO: 4892 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (6)..(6): base is a locked nucleic acid
  modified_base (9)..(9): base is a locked nucleic acid
  modified_base (11)..(11): base is a locked nucleic acid
cagavatrrtbatytayca

SEQ ID NO: 4893 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (7)..(7): base is a locked nucleic acid
  modified_base (9)..(9): base is a locked nucleic acid
  modified_base (11)..(11): base is a locked nucleic acid
ccagavatrgtbatytayc

SEQ ID NO: 4894 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (4)..(4): base is a locked nucleic acid
  modified_base (9)..(9): base is a locked nucleic acid
  modified_base (11)..(11): base is a locked nucleic acid
cagavatrrtbatytayca

SEQ ID NO: 4895 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (2)..(2): base is a locked nucleic acid
  modified_base (9)..(9): base is a locked nucleic acid
  modified_base (11)..(11): base is a locked nucleic acid
ccagavatrgtbatytayc

SEQ ID NO: 4896 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
cagavatrrtbatytayca

SEQ ID NO: 4897 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
  modified_base (9)..(9): base is a locked nucleic acid
  modified_base (11)..(11): base is a locked nucleic acid
ccagavatrgtbatytayc

SEQ ID NO: 4898 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (12)..(12): base is a locked nucleic acid
agavatrrtbatytayc

SEQ ID NO: 4899 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (12)..(12): base is a locked nucleic acid
cagavatrgtbatytay

SEQ ID NO: 4900 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (10)..(10): base is a locked nucleic acid
agavatrrtbatytayc

SEQ ID NO: 4901 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
cagavatrgtbatytay

SEQ ID NO: 4902 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (13)..(13): base is a locked nucleic acid
agavatrrtbatytayc

SEQ ID NO: 4903 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (17)..(17): base is a locked nucleic acid
cagavatrgtbatytay

SEQ ID NO: 4904 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (16)..(16): base is a locked nucleic acid
agavatrrtbatytayc

SEQ ID NO: 4905 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (16)..(16): base is a locked nucleic acid
cagavatrgtbatytay

SEQ ID NO: 4906 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (7)..(7): base is a locked nucleic acid
agavatrrtbatytayc

SEQ ID NO: 4907 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (5)..(5): base is a locked nucleic acid
cagavatrgtbatytay

SEQ ID NO: 4908 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
agavatrrtbatytayc

SEQ ID NO: 4909 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (6)..(6): base is a locked nucleic acid
cagavatrgtbatytay

SEQ ID NO: 4910 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (5)..(5): base is a locked nucleic acid
agavatrrtbatytayc

SEQ ID NO: 4911 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (3)..(3): base is a locked nucleic acid
cagavatrgtbatytay

SEQ ID NO: 4912 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (3)..(3): base is a locked nucleic acid
agavatrrtbatytayc

SEQ ID NO: 4913 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (7)..(7): base is a locked nucleic acid
cagavatrgtbatytay

SEQ ID NO: 4914 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
agavatrrtbatytayc

SEQ ID NO: 4915 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (17)..(17): base is a locked nucleic acid
cagavatrgtbatytay

SEQ ID NO: 4916 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (16)..(16): base is a locked nucleic acid
agavatrrtbatytayc

SEQ ID NO: 4917 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (12)..(12): base is a locked nucleic acid
cagavatrgtbatytay

SEQ ID NO: 4918 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (15)..(15): base is a locked nucleic acid
agavatrrtbatytayc

SEQ ID NO: 4919 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (11)..(11): base is a locked nucleic acid
cagavatrgtbatytay

SEQ ID NO: 4920 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (12)..(12): base is a locked nucleic acid
agavatrrtbatytayc

SEQ ID NO: 4921 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (14)..(14): base is a locked nucleic acid
cagavatrgtbatytay

SEQ ID NO: 4922 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (4)..(4): base is a locked nucleic acid
  modified_base (8)..(8): base is a locked nucleic acid
  modified_base (10)..(10): base is a locked nucleic acid
agavatrrtbatytayc

SEQ ID NO: 4923 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (3)..(3): base is a locked nucleic acid
  modified_base (8)..(8): base is a locked nucleic acid
  modified_base (10)..(10): base is a locked nucleic acid
cagavatrgtbatytay

SEQ ID NO: 4924 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (2)..(2): base is a locked nucleic acid
  modified_base (8)..(8): base is a locked nucleic acid
  modified_base (10)..(10): base is a locked nucleic acid
agavatrrtbatytayc

SEQ ID NO: 4925 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (4)..(4): base is a locked nucleic acid
  modified_base (8)..(8): base is a locked nucleic acid
  modified_base (10)..(10): base is a locked nucleic acid
cagavatrgtbatytay

SEQ ID NO: 4926 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (5)..(5): base is a locked nucleic acid
  modified_base (8)..(8): base is a locked nucleic acid
  modified_base (10)..(10): base is a locked nucleic acid
agavatrrtbatytayc

SEQ ID NO: 4927 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (6)..(6): base is a locked nucleic acid
  modified_base (8)..(8): base is a locked nucleic acid
  modified_base (10)..(10): base is a locked nucleic acid
cagavatrgtbatytay

SEQ ID NO: 4928 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (3)..(3): base is a locked nucleic acid
  modified_base (8)..(8): base is a locked nucleic acid
  modified_base (10)..(10): base is a locked nucleic acid
agavatrrtbatytayc

SEQ ID NO: 4929 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (1)..(1): base is a locked nucleic acid
  modified_base (8)..(8): base is a locked nucleic acid
  modified_base (10)..(10): base is a locked nucleic acid
cagavatrgtbatytay

SEQ ID NO: 4930 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
agavatrrtbatytayc

SEQ ID NO: 4931 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
cagavatrgtbatytay

SEQ ID NO: 4932 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (12)..(12): base is a locked nucleic acid
agavatrrtbatyta

SEQ ID NO: 4933 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (12)..(12): base is a locked nucleic acid
cagavatrgtbatyt

SEQ ID NO: 4934 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (10)..(10): base is a locked nucleic acid
agavatrrtbatyta

SEQ ID NO: 4935 - DNA, 16 bp, Artificial Sequence
  Oligonucleotide probe
  misc_binding (1)..(16): Hybridization probe for the specific detection of wild-type HIV-1 at codon 179 of the reverse transcriptase gene.
cagavatrgtbatyta

SEQ ID NO: 4936 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (13)..(13): base is a locked nucleic acid
agavatrrtbatyta

SEQ ID NO: 4937 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
agavatrrtbatyta

SEQ ID NO: 4938 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
cagavatrgtbatyt

SEQ ID NO: 4939 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (7)..(7): base is a locked nucleic acid
agavatrrtbatyta

SEQ ID NO: 4940 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (5)..(5): base is a locked nucleic acid
cagavatrgtbatyt

SEQ ID NO: 4941 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
agavatrrtbatyta

SEQ ID NO: 4942 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (6)..(6): base is a locked nucleic acid
cagavatrgtbatyt

SEQ ID NO: 4943 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (5)..(5): base is a locked nucleic acid
agavatrrtbatyta

SEQ ID NO: 4944 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (3)..(3): base is a locked nucleic acid
cagavatrgtbatyt

SEQ ID NO: 4945 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (3)..(3): base is a locked nucleic acid
agavatrrtbatyta

SEQ ID NO: 4946 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (7)..(7): base is a locked nucleic acid
cagavatrgtbatyt

SEQ ID NO: 4947 - DNA, 16 bp, Artificial Sequence
  Oligonucleotide probe
  misc_binding (1)..(16): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
agavatrrtbatytay

SEQ ID NO: 4948 - DNA, 16 bp, Artificial Sequence
  Oligonucleotide probe
  misc_binding (1)..(16): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
cagavatrgtbatyta

SEQ ID NO: 4949 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
agavatrrtbatyta

SEQ ID NO: 4950 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (12)..(12): base is a locked nucleic acid
cagavatrgtbatyt

SEQ ID NO: 4951 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (15)..(15): base is a locked nucleic acid
agavatrrtbatyta

SEQ ID NO: 4952 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (11)..(11): base is a locked nucleic acid
cagavatrgtbatyt

SEQ ID NO: 4953 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (12)..(12): base is a locked nucleic acid
agavatrrtbatyta

SEQ ID NO: 4954 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (14)..(14): base is a locked nucleic acid
cagavatrgtbatyt

SEQ ID NO: 4955 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (4)..(4): base is a locked nucleic acid
  modified_base (8)..(8): base is a locked nucleic acid
  modified_base (10)..(10): base is a locked nucleic acid
agavatrrtbatyta

SEQ ID NO: 4956 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (3)..(3): base is a locked nucleic acid
  modified_base (8)..(8): base is a locked nucleic acid
  modified_base (10)..(10): base is a locked nucleic acid
cagavatrgtbatyt

SEQ ID NO: 4957 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (2)..(2): base is a locked nucleic acid
  modified_base (8)..(8): base is a locked nucleic acid
  modified_base (10)..(10): base is a locked nucleic acid
agavatrrtbatyta

SEQ ID NO: 4958 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (4)..(4): base is a locked nucleic acid
  modified_base (8)..(8): base is a locked nucleic acid
  modified_base (10)..(10): base is a locked nucleic acid
cagavatrgtbatyt

SEQ ID NO: 4959 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (5)..(5): base is a locked nucleic acid
  modified_base (8)..(8): base is a locked nucleic acid
  modified_base (10)..(10): base is a locked nucleic acid
agavatrrtbatyta

SEQ ID NO: 4960 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (6)..(6): base is a locked nucleic acid
  modified_base (8)..(8): base is a locked nucleic acid
  modified_base (10)..(10): base is a locked nucleic acid
cagavatrgtbatyt

SEQ ID NO: 4961 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (3)..(3): base is a locked nucleic acid
  modified_base (8)..(8): base is a locked nucleic acid
  modified_base (10)..(10): base is a locked nucleic acid
agavatrrtbatyta

SEQ ID NO: 4962 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (1)..(1): base is a locked nucleic acid
  modified_base (8)..(8): base is a locked nucleic acid
  modified_base (10)..(10): base is a locked nucleic acid
cagavatrgtbatyt

SEQ ID NO: 4963 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
agavatrrtbatyta

SEQ ID NO: 4964 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
cagavatrgtbatyt

SEQ ID NO: 4965 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (12)..(12): base is a locked nucleic acid
agavatrrtbaty

SEQ ID NO: 4966 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (12)..(12): base is a locked nucleic acid
cagavatrgtbat

SEQ ID NO: 4967 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (10)..(10): base is a locked nucleic acid
agavatrrtbaty

SEQ ID NO: 4968 - DNA, 14 bp, Artificial Sequence
  Oligonucleotide probe
  misc_binding (1)..(14): Hybridization probe for the specific detection of wild-type HIV-1 at codon 179 of the reverse transcriptase gene.
cagavatrgtbaty

SEQ ID NO: 4969 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (13)..(13): base is a locked nucleic acid
agavatrrtbaty

SEQ ID NO: 4970 - DNA, 14 bp, Artificial Sequence
  Oligonucleotide probe
  misc_binding (1)..(14): Hybridization probe for the specific detection of wild-type HIV-1 at codon 179 of the reverse transcriptase gene.
agavatrrtbatyt

SEQ ID NO: 4971 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (7)..(7): base is a locked nucleic acid
agavatrrtbaty

SEQ ID NO: 4972 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (5)..(5): base is a locked nucleic acid
cagavatrgtbat

SEQ ID NO: 4973 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (8)..(8): base is a locked nucleic acid
agavatrrtbaty

SEQ ID NO: 4974 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (6)..(6): base is a locked nucleic acid
cagavatrgtbat

SEQ ID NO: 4975 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (5)..(5): base is a locked nucleic acid
agavatrrtbaty

SEQ ID NO: 4976 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (3)..(3): base is a locked nucleic acid
cagavatrgtbat

SEQ ID NO: 4977 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (3)..(3): base is a locked nucleic acid
agavatrrtbaty

SEQ ID NO: 4978 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (7)..(7): base is a locked nucleic acid
cagavatrgtbat

SEQ ID NO: 4979 - DNA, 14 bp, Artificial Sequence
  Oligonucleotide probe
  misc_binding (1)..(14): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
agavatrrtbatyt

SEQ ID NO: 4980 - DNA, 14 bp, Artificial Sequence
  Oligonucleotide probe
  misc_binding (1)..(14): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
cagavatrgtbaty

SEQ ID NO: 4981 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (12)..(12): base is a locked nucleic acid
cagavatrgtbat

SEQ ID NO: 4982 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (11)..(11): base is a locked nucleic acid
cagavatrgtbat

SEQ ID NO: 4983 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
  modified_base (12)..(12): base is a locked nucleic acid
agavatrrtbaty

SEQ ID NO: 4984 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
cagavatrgtbat

SEQ ID NO: 4985 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (4)..(4): base is a locked nucleic acid
  modified_base (8)..(8): base is a locked nucleic acid
  modified_base (10)..(10): base is a locked nucleic acid
agavatrrtbaty

SEQ ID NO: 4986 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (3)..(3): base is a locked nucleic acid
  modified_base (8)..(8): base is a locked nucleic acid
  modified_base (10)..(10): base is a locked nucleic acid
cagavatrgtbat

SEQ ID NO: 4987 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (2)..(2): base is a locked nucleic acid
  modified_base (8)..(8): base is a locked nucleic acid
  modified_base (10)..(10): base is a locked nucleic acid
agavatrrtbaty

SEQ ID NO: 4988 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (4)..(4): base is a locked nucleic acid
  modified_base (8)..(8): base is a locked nucleic acid
  modified_base (10)..(10): base is a locked nucleic acid
cagavatrgtbat

SEQ ID NO: 4989 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (5)..(5): base is a locked nucleic acid
  modified_base (8)..(8): base is a locked nucleic acid
  modified_base (10)..(10): base is a locked nucleic acid
agavatrrtbaty

SEQ ID NO: 4990 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (6)..(6): base is a locked nucleic acid
  modified_base (8)..(8): base is a locked nucleic acid
  modified_base (10)..(10): base is a locked nucleic acid
cagavatrgtbat

SEQ ID NO: 4991 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (3)..(3): base is a locked nucleic acid
  modified_base (8)..(8): base is a locked nucleic acid
  modified_base (10)..(10): base is a locked nucleic acid
agavatrrtbaty

SEQ ID NO: 4992 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (1)..(1): base is a locked nucleic acid
  modified_base (8)..(8): base is a locked nucleic acid
  modified_base (10)..(10): base is a locked nucleic acid
cagavatrgtbat

SEQ ID NO: 4993 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
agavatrrtbaty

SEQ ID NO: 4994 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
  modified_base (8)..(8): base is a locked nucleic acid
  modified_base (10)..(10): base is a locked nucleic acid
cagavatrgtbat

SEQ ID NO: 4995 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
  misc_feature (7)..(7): n is a, c, g, or t
atagatnactatgtc

SEQ ID NO: 4996 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
cagavatrrtbatytayca

SEQ ID NO: 4997 - DNA, 19 bp, Artificial Sequence
  Oligonucleotide probe
  misc_binding (1)..(19): Hybridization probe for the specific detection of wild-type HIV-1 at codon 179 of the reverse transcriptase gene.
ccagavatrgtbatytayc

SEQ ID NO: 4998 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
agavatrrtbatytayc

SEQ ID NO: 4999 - DNA, 17 bp, Artificial Sequence
  Oligonucleotide probe
  misc_binding (1)..(17): Hybridization probe for the specific detection of wild-type HIV-1 at codon 179 of the reverse transcriptase gene.
cagavatrgtbatytay

SEQ ID NO: 5000 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
agavatrrtbatyta

SEQ ID NO: 5001 - DNA, 15 bp, Artificial Sequence
  Oligonucleotide probe
  misc_binding (1)..(15): Hybridization probe for the specific detection of wild-type HIV-1 at codon 179 of the reverse transcriptase gene.
cagavatrgtbatyt

SEQ ID NO: 5002 - DNA, 16 bp, Artificial Sequence
  Oligonucleotide probe
  misc_binding (1)..(16): Hybridization probe for the specific detection of wild-type HIV-1 at codon 179 of the reverse transcriptase gene.
agavatrrtbatytay

SEQ ID NO: 5003 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
agavatrrtbaty

SEQ ID NO: 5004 - DNA, 13 bp, Artificial Sequence
  Oligonucleotide probe
  misc_binding (1)..(13): Hybridization probe for the specific detection of wild-type HIV-1 at codon 179 of the reverse transcriptase gene.
cagavatrgtbat

SEQ ID NO: 5005 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (12)..(12): base is a locked nucleic acid
trrtbatytaycaatayrt

SEQ ID NO: 5006 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (15)..(15): base is a locked nucleic acid
trrtbatytaycaatayrt

SEQ ID NO: 5007 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (18)..(18): base is a locked nucleic acid
trrtbatytaycaatayrt

SEQ ID NO: 5008 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (16)..(16): base is a locked nucleic acid
trrtbatytaycaatayrt

SEQ ID NO: 5009 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (5)..(5): base is a locked nucleic acid
trrtbatytaycaatayrt

SEQ ID NO: 5010 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (7)..(7): base is a locked nucleic acid
trrtbatytaycaatayrt

SEQ ID NO: 5011 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (2)..(2): base is a locked nucleic acid
trrtbatytaycaatayrt

SEQ ID NO: 5012 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (9)..(9): base is a locked nucleic acid
trrtbatytaycaatayrt

SEQ ID NO: 5013 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (9)..(9): base is a locked nucleic acid
  modified_base (11)..(11): base is a locked nucleic acid
  modified_base (17)..(17): base is a locked nucleic acid
trrtbatytaycaatayrt

SEQ ID NO: 5014 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (9)..(9): base is a locked nucleic acid
  modified_base (11)..(11): base is a locked nucleic acid
  modified_base (18)..(18): base is a locked nucleic acid
trrtbatytaycaatayrt

SEQ ID NO: 5015 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (9)..(9): base is a locked nucleic acid
  modified_base (11)..(11): base is a locked nucleic acid
  modified_base (14)..(14): base is a locked nucleic acid
trrtbatytaycaatayrt

SEQ ID NO: 5016 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (9)..(9): base is a locked nucleic acid
  modified_base (11)..(11): base is a locked nucleic acid
  modified_base (13)..(13): base is a locked nucleic acid
trrtbatytaycaatayrt

SEQ ID NO: 5017 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (5)..(5): base is a locked nucleic acid
  modified_base (9)..(9): base is a locked nucleic acid
  modified_base (11)..(11): base is a locked nucleic acid
trrtbatytaycaatayrt

SEQ ID NO: 5018 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (4)..(4): base is a locked nucleic acid
  modified_base (9)..(9): base is a locked nucleic acid
  modified_base (11)..(11): base is a locked nucleic acid
trrtbatytaycaatayrt

SEQ ID NO: 5019 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (2)..(2): base is a locked nucleic acid
  modified_base (9)..(9): base is a locked nucleic acid
  modified_base (11)..(11): base is a locked nucleic acid
trrtbatytaycaatayrt

SEQ ID NO: 5020 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (8)..(8): base is a locked nucleic acid
  modified_base (9)..(9): base is a locked nucleic acid
  modified_base (11)..(11): base is a locked nucleic acid
trrtbatytaycaatayrt

SEQ ID NO: 5021 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
  modified_base (9)..(9): base is a locked nucleic acid
  modified_base (11)..(11): base is a locked nucleic acid
trrtbatytaycaatayrt

SEQ ID NO: 5022 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (11)..(11): base is a locked nucleic acid
rrtbatytaycaatayr

SEQ ID NO: 5023 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (14)..(14): base is a locked nucleic acid
rrtbatytaycaatayr

SEQ ID NO: 5024 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (17)..(17): base is a locked nucleic acid
rrtbatytaycaatayr

SEQ ID NO: 5025 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (15)..(15): base is a locked nucleic acid
rrtbatytaycaatayr

SEQ ID NO: 5026 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (4)..(4): base is a locked nucleic acid
rrtbatytaycaatayr

SEQ ID NO: 5027 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (6)..(6): base is a locked nucleic acid
rrtbatytaycaatayr

SEQ ID NO: 5028 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (1)..(1): base is a locked nucleic acid
rrtbatytaycaatayr

SEQ ID NO: 5029 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (8)..(8): base is a locked nucleic acid
rrtbatytaycaatayr

SEQ ID NO: 5030 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (16)..(16): base is a locked nucleic acid
rrtbatytaycaatayr

SEQ ID NO: 5031 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (17)..(17): base is a locked nucleic acid
rrtbatytaycaatayr

SEQ ID NO: 5032 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (13)..(13): base is a locked nucleic acid
rrtbatytaycaatayr

SEQ ID NO: 5033 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (12)..(12): base is a locked nucleic acid
rrtbatytaycaatayr

SEQ ID NO: 5034 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (4)..(4): base is a locked nucleic acid
  modified_base (8)..(8): base is a locked nucleic acid
  modified_base (10)..(10): base is a locked nucleic acid
rrtbatytaycaatayr

SEQ ID NO: 5035 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (3)..(3): base is a locked nucleic acid
  modified_base (8)..(8): base is a locked nucleic acid
  modified_base (10)..(10): base is a locked nucleic acid
rrtbatytaycaatayr

SEQ ID NO: 5036 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (1)..(1): base is a locked nucleic acid
  modified_base (8)..(8): base is a locked nucleic acid
  modified_base (10)..(10): base is a locked nucleic acid
rrtbatytaycaatayr

SEQ ID NO: 5037 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (7)..(7): base is a locked nucleic acid
  modified_base (8)..(8): base is a locked nucleic acid
  modified_base (10)..(10): base is a locked nucleic acid
rrtbatytaycaatayr

SEQ ID NO: 5038 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
rrtbatytaycaatayr

SEQ ID NO: 5039 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (11)..(11): base is a locked nucleic acid
rrtbatytaycaata

SEQ ID NO: 5040 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (14)..(14): base is a locked nucleic acid
rrtbatytaycaata

SEQ ID NO: 5041 - DNA, 16 bp, Artificial Sequence
  Oligonucleotide probe
  misc_binding (1)..(16): Hybridization probe for the specific detection of wild-type HIV-1 at codon 181 of the reverse transcriptase gene.
rrtbatytaycaatay

SEQ ID NO: 5042 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (15)..(15): base is a locked nucleic acid
rrtbatytaycaata

SEQ ID NO: 5043 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (4)..(4): base is a locked nucleic acid
rrtbatytaycaata

SEQ ID NO: 5044 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (6)..(6): base is a locked nucleic acid
rrtbatytaycaata

SEQ ID NO: 5045 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (1)..(1): base is a locked nucleic acid
rrtbatytaycaata

SEQ ID NO: 5046 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (8)..(8): base is a locked nucleic acid
rrtbatytaycaata

SEQ ID NO: 5047 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
rrtbatytaycaata

SEQ ID NO: 5048 - DNA, 16 bp, Artificial Sequence
  Oligonucleotide probe
  misc_binding (1)..(16): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
rrtbatytaycaatay

SEQ ID NO: 5049 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (13)..(13): base is a locked nucleic acid
rrtbatytaycaata

SEQ ID NO: 5050 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (12)..(12): base is a locked nucleic acid
rrtbatytaycaata

SEQ ID NO: 5051 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (4)..(4): base is a locked nucleic acid
  modified_base (8)..(8): base is a locked nucleic acid
  modified_base (10)..(10): base is a locked nucleic acid
rrtbatytaycaata

SEQ ID NO: 5052 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (3)..(3): base is a locked nucleic acid
  modified_base (8)..(8): base is a locked nucleic acid
  modified_base (10)..(10): base is a locked nucleic acid
rrtbatytaycaata

SEQ ID NO: 5053 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (1)..(1): base is a locked nucleic acid
  modified_base (8)..(8): base is a locked nucleic acid
  modified_base (10)..(10): base is a locked nucleic acid
rrtbatytaycaata

SEQ ID NO: 5054 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (7)..(7): base is a locked nucleic acid
  modified_base (8)..(8): base is a locked nucleic acid
  modified_base (10)..(10): base is a locked nucleic acid
rrtbatytaycaata

SEQ ID NO: 5055 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
rrtbatytaycaata

SEQ ID NO: 5056 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (11)..(11): base is a locked nucleic acid
rrtbatytaycaa

SEQ ID NO: 5057 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
rrtbatytaycaa

SEQ ID NO: 5058 - DNA, 14 bp, Artificial Sequence
  Oligonucleotide probe
  misc_binding (1)..(14): Hybridization probe for the specific detection of wild-type HIV-1 at codon 181 of the reverse transcriptase gene.
rrtbatytaycaat

SEQ ID NO: 5059 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (4)..(4): base is a locked nucleic acid
rrtbatytaycaa

SEQ ID NO: 5060 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (6)..(6): base is a locked nucleic acid
rrtbatytaycaa

SEQ ID NO: 5061 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (1)..(1): base is a locked nucleic acid
rrtbatytaycaa

SEQ ID NO: 5062 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (8)..(8): base is a locked nucleic acid
rrtbatytaycaa

SEQ ID NO: 5063 - DNA, 14 bp, Artificial Sequence
  Oligonucleotide probe
  misc_binding (1)..(14): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
rrtbatytaycaat

SEQ ID NO: 5064 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (13)..(13): base is a locked nucleic acid
rrtbatytaycaa

SEQ ID NO: 5065 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
  modified_base (12)..(12): base is a locked nucleic acid
rrtbatytaycaa

SEQ ID NO: 5066 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (4)..(4): base is a locked nucleic acid
  modified_base (8)..(8): base is a locked nucleic acid
  modified_base (10)..(10): base is a locked nucleic acid
rrtbatytaycaa

SEQ ID NO: 5067 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (3)..(3): base is a locked nucleic acid
  modified_base (8)..(8): base is a locked nucleic acid
  modified_base (10)..(10): base is a locked nucleic acid
rrtbatytaycaa

SEQ ID NO: 5068 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (1)..(1): base is a locked nucleic acid
  modified_base (8)..(8): base is a locked nucleic acid
  modified_base (10)..(10): base is a locked nucleic acid
rrtbatytaycaa

SEQ ID NO: 5069 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (7)..(7): base is a locked nucleic acid
  modified_base (8)..(8): base is a locked nucleic acid
  modified_base (10)..(10): base is a locked nucleic acid
rrtbatytaycaa

SEQ ID NO: 5070 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
  modified_base (8)..(8): base is a locked nucleic acid
  modified_base (10)..(10): base is a locked nucleic acid
rrtbatytaycaa

SEQ ID NO: 5071 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
ttatctaycaataca

SEQ ID NO: 5072 - DNA, 19 bp, Artificial Sequence
  Oligonucleotide probe
  misc_binding (1)..(19): Hybridization probe for the specific detection of wild-type HIV-1 at codon 181 of the reverse transcriptase gene.
trrtbatytaycaatayrt

SEQ ID NO: 5073 - DNA, 17 bp, Artificial Sequence
  Oligonucleotide probe
  misc_binding (1)..(17): Hybridization probe for the specific detection of wild-type HIV-1 at codon 181 of the reverse transcriptase gene.
rrtbatytaycaatayr

SEQ ID NO: 5074 - DNA, 15 bp, Artificial Sequence
  Oligonucleotide probe
  misc_binding (1)..(15): Hybridization probe for the specific detection of wild-type HIV-1 at codon 181 of the reverse transcriptase gene.
rrtbatytaycaata

SEQ ID NO: 5075 - DNA, 13 bp, Artificial Sequence
  Oligonucleotide probe
  misc_binding (1)..(13): Hybridization probe for the specific detection of wild-type HIV-1 at codon 181 of the reverse transcriptase gene.
rrtbatytaycaa

SEQ ID NO: 5076 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (13)..(13): base is a locked nucleic acid
taycaatayatggatgayt

SEQ ID NO: 5077 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (19)..(19): base is a locked nucleic acid
ycaatayrtggatgayttr

SEQ ID NO: 5078 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (19)..(19): base is a locked nucleic acid
taycaatayatggatgayt

SEQ ID NO: 5079 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (12)..(12): base is a locked nucleic acid
ycaatayrtggatgayttr

SEQ ID NO: 5080 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (16)..(16): base is a locked nucleic acid
taycaatayatggatgayt

SEQ ID NO: 5081 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (13)..(13): base is a locked nucleic acid
ycaatayrtggatgayttr

SEQ ID NO: 5082 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (17)..(17): base is a locked nucleic acid
taycaatayatggatgayt

SEQ ID NO: 5083 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (15)..(15): base is a locked nucleic acid
ycaatayrtggatgayttr

SEQ ID NO: 5084 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
taycaatayatggatgayt

SEQ ID NO: 5085 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (5)..(5): base is a locked nucleic acid
ycaatayrtggatgayttr

SEQ ID NO: 5086 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (7)..(7): base is a locked nucleic acid
taycaatayatggatgayt

SEQ ID NO: 5087 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (3)..(3): base is a locked nucleic acid
ycaatayrtggatgayttr

SEQ ID NO: 5088 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (4)..(4): base is a locked nucleic acid
taycaatayatggatgayt

SEQ ID NO: 5089 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (2)..(2): base is a locked nucleic acid
ycaatayrtggatgayttr

SEQ ID NO: 5090 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (6)..(6): base is a locked nucleic acid
taycaatayatggatgayt

SEQ ID NO: 5091 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (8)..(8): base is a locked nucleic acid
ycaatayrtggatgayttr

SEQ ID NO: 5092 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (14)..(14): base is a locked nucleic acid
taycaatayatggatgayt

SEQ ID NO: 5093 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (13)..(13): base is a locked nucleic acid
ycaatayrtggatgayttr

SEQ ID NO: 5094 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (16)..(16): base is a locked nucleic acid
taycaatayatggatgayt

SEQ ID NO: 5095 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (14)..(14): base is a locked nucleic acid
ycaatayrtggatgayttr

SEQ ID NO: 5096 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (19)..(19): base is a locked nucleic acid
taycaatayatggatgayt

SEQ ID NO: 5097 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (19)..(19): base is a locked nucleic acid
ycaatayrtggatgayttr

SEQ ID NO: 5098 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (15)..(15): base is a locked nucleic acid
taycaatayatggatgayt

SEQ ID NO: 5099 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
  modified_base (15)..(15): base is a locked nucleic acid
ycaatayrtggatgayttr

SEQ ID NO: 5100 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (2)..(2): base is a locked nucleic acid
  modified_base (9)..(9): base is a locked nucleic acid
  modified_base (11)..(11): base is a locked nucleic acid
taycaatayatggatgayt

SEQ ID NO: 5101 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (7)..(7): base is a locked nucleic acid
  modified_base (9)..(9): base is a locked nucleic acid
  modified_base (11)..(11): base is a locked nucleic acid
ycaatayrtggatgayttr

SEQ ID NO: 5102 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (8)..(8): base is a locked nucleic acid
  modified_base (9)..(9): base is a locked nucleic acid
  modified_base (11)..(11): base is a locked nucleic acid
taycaatayatggatgayt

SEQ ID NO: 5103 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (2)..(2): base is a locked nucleic acid
  modified_base (9)..(9): base is a locked nucleic acid
  modified_base (11)..(11): base is a locked nucleic acid
ycaatayrtggatgayttr

SEQ ID NO: 5104 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (4)..(4): base is a locked nucleic acid
  modified_base (9)..(9): base is a locked nucleic acid
  modified_base (11)..(11): base is a locked nucleic acid
taycaatayatggatgayt

SEQ ID NO: 5105 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (5)..(5): base is a locked nucleic acid
  modified_base (9)..(9): base is a locked nucleic acid
  modified_base (11)..(11): base is a locked nucleic acid
ycaatayrtggatgayttr

SEQ ID NO: 5106 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (5)..(5): base is a locked nucleic acid
  modified_base (9)..(9): base is a locked nucleic acid
  modified_base (11)..(11): base is a locked nucleic acid
taycaatayatggatgayt

SEQ ID NO: 5107 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (8)..(8): base is a locked nucleic acid
  modified_base (9)..(9): base is a locked nucleic acid
  modified_base (11)..(11): base is a locked nucleic acid
ycaatayrtggatgayttr

SEQ ID NO: 5108 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
taycaatayatggatgayt

SEQ ID NO: 5109 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
  modified_base (9)..(9): base is a locked nucleic acid
  modified_base (11)..(11): base is a locked nucleic acid
ycaatayrtggatgayttr

SEQ ID NO: 5110 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (12)..(12): base is a locked nucleic acid
aycaatayatggatgay

SEQ ID NO: 5111 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
caatayrtggatgaytt

SEQ ID NO: 5112 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
aycaatayatggatgay

SEQ ID NO: 5113 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (11)..(11): base is a locked nucleic acid
caatayrtggatgaytt

SEQ ID NO: 5114 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (15)..(15): base is a locked nucleic acid
aycaatayatggatgay

SEQ ID NO: 5115 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (12)..(12): base is a locked nucleic acid
caatayrtggatgaytt

SEQ ID NO: 5116 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (16)..(16): base is a locked nucleic acid
aycaatayatggatgay

SEQ ID NO: 5117 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (14)..(14): base is a locked nucleic acid
caatayrtggatgaytt

SEQ ID NO: 5118 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
aycaatayatggatgay

SEQ ID NO: 5119 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (4)..(4): base is a locked nucleic acid
caatayrtggatgaytt

SEQ ID NO: 5120 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (6)..(6): base is a locked nucleic acid
aycaatayatggatgay

SEQ ID NO: 5121 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (2)..(2): base is a locked nucleic acid
caatayrtggatgaytt

SEQ ID NO: 5122 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (3)..(3): base is a locked nucleic acid
aycaatayatggatgay

SEQ ID NO: 5123 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (1)..(1): base is a locked nucleic acid
caatayrtggatgaytt

SEQ ID NO: 5124 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (5)..(5): base is a locked nucleic acid
aycaatayatggatgay

SEQ ID NO: 5125 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (7)..(7): base is a locked nucleic acid
caatayrtggatgaytt

SEQ ID NO: 5126 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (13)..(13): base is a locked nucleic acid
aycaatayatggatgay

SEQ ID NO: 5127 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (12)..(12): base is a locked nucleic acid
caatayrtggatgaytt

SEQ ID NO: 5128 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (15)..(15): base is a locked nucleic acid
aycaatayatggatgay

SEQ ID NO: 5129 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (13)..(13): base is a locked nucleic acid
caatayrtggatgaytt

SEQ ID NO: 5130 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
aycaatayatggatgay

SEQ ID NO: 5131 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
caatayrtggatgaytt

SEQ ID NO: 5132 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (14)..(14): base is a locked nucleic acid
aycaatayatggatgay

SEQ ID NO: 5133 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (14)..(14): base is a locked nucleic acid
caatayrtggatgaytt

SEQ ID NO: 5134 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (1)..(1): base is a locked nucleic acid
  modified_base (8)..(8): base is a locked nucleic acid
  modified_base (10)..(10): base is a locked nucleic acid
aycaatayatggatgay

SEQ ID NO: 5135 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (6)..(6): base is a locked nucleic acid
  modified_base (8)..(8): base is a locked nucleic acid
  modified_base (10)..(10): base is a locked nucleic acid
caatayrtggatgaytt

SEQ ID NO: 5136 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (7)..(7): base is a locked nucleic acid
  modified_base (8)..(8): base is a locked nucleic acid
  modified_base (10)..(10): base is a locked nucleic acid
aycaatayatggatgay

SEQ ID NO: 5137 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (1)..(1): base is a locked nucleic acid
  modified_base (8)..(8): base is a locked nucleic acid
  modified_base (10)..(10): base is a locked nucleic acid
caatayrtggatgaytt

SEQ ID NO: 5138 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (3)..(3): base is a locked nucleic acid
  modified_base (8)..(8): base is a locked nucleic acid
  modified_base (10)..(10): base is a locked nucleic acid
aycaatayatggatgay

SEQ ID NO: 5139 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (4)..(4): base is a locked nucleic acid
  modified_base (8)..(8): base is a locked nucleic acid
  modified_base (10)..(10): base is a locked nucleic acid
caatayrtggatgaytt

SEQ ID NO: 5140 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (4)..(4): base is a locked nucleic acid
  modified_base (8)..(8): base is a locked nucleic acid
  modified_base (10)..(10): base is a locked nucleic acid
aycaatayatggatgay

SEQ ID NO: 5141 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (7)..(7): base is a locked nucleic acid
  modified_base (8)..(8): base is a locked nucleic acid
  modified_base (10)..(10): base is a locked nucleic acid
caatayrtggatgaytt

SEQ ID NO: 5142 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
aycaatayatggatgay

SEQ ID NO: 5143 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
caatayrtggatgaytt

SEQ ID NO: 5144 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (12)..(12): base is a locked nucleic acid
aycaatayatggatg

SEQ ID NO: 5145 - DNA, 16 bp, Artificial Sequence
  Oligonucleotide probe
  misc_binding (1)..(16): Hybridization probe for the specific detection of wild-type HIV-1 at codon 184 of the reverse transcriptase gene.
caatayrtggatgayt

SEQ ID NO: 5146 - DNA, 16 bp, Artificial Sequence
  Oligonucleotide probe
  misc_binding (1)..(16): Hybridization probe for the specific detection of wild-type HIV-1 at codon 184 of the reverse transcriptase gene.
aycaatayatggatga

SEQ ID NO: 5147 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (11)..(11): base is a locked nucleic acid
caatayrtggatgay

SEQ ID NO: 5148 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (15)..(15): base is a locked nucleic acid
aycaatayatggatg

SEQ ID NO: 5149 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (12)..(12): base is a locked nucleic acid
caatayrtggatgay

SEQ ID NO: 5150 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
aycaatayatggatg

SEQ ID NO: 5151 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (14)..(14): base is a locked nucleic acid
caatayrtggatgay

SEQ ID NO: 5152 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
aycaatayatggatg

SEQ ID NO: 5153 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (4)..(4): base is a locked nucleic acid
caatayrtggatgay

SEQ ID NO: 5154 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (6)..(6): base is a locked nucleic acid
aycaatayatggatg

SEQ ID NO: 5155 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (2)..(2): base is a locked nucleic acid
caatayrtggatgay

SEQ ID NO: 5156 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (3)..(3): base is a locked nucleic acid
aycaatayatggatg

SEQ ID NO: 5157 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (1)..(1): base is a locked nucleic acid
caatayrtggatgay

SEQ ID NO: 5158 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (5)..(5): base is a locked nucleic acid
aycaatayatggatg

SEQ ID NO: 5159 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (7)..(7): base is a locked nucleic acid
caatayrtggatgay

SEQ ID NO: 5160 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (13)..(13): base is a locked nucleic acid
aycaatayatggatg

SEQ ID NO: 5161 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (12)..(12): base is a locked nucleic acid
caatayrtggatgay

SEQ ID NO: 5162 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (15)..(15): base is a locked nucleic acid
aycaatayatggatg

SEQ ID NO: 5163 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (13)..(13): base is a locked nucleic acid
caatayrtggatgay

SEQ ID NO: 5164 - DNA, 16 bp, Artificial Sequence
  Oligonucleotide probe
  misc_binding (1)..(16): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
aycaatayatggatga

SEQ ID NO: 5165 - DNA, 16 bp, Artificial Sequence
  Oligonucleotide probe
  misc_binding (1)..(16): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
caatayrtggatgayt

SEQ ID NO: 5166 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (14)..(14): base is a locked nucleic acid
aycaatayatggatg

SEQ ID NO: 5167 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (14)..(14): base is a locked nucleic acid
caatayrtggatgay

SEQ ID NO: 5168 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (1)..(1): base is a locked nucleic acid
  modified_base (8)..(8): base is a locked nucleic acid
  modified_base (10)..(10): base is a locked nucleic acid
aycaatayatggatg

SEQ ID NO: 5169 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (6)..(6): base is a locked nucleic acid
  modified_base (8)..(8): base is a locked nucleic acid
  modified_base (10)..(10): base is a locked nucleic acid
caatayrtggatgay

SEQ ID NO: 5170 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (7)..(7): base is a locked nucleic acid
  modified_base (8)..(8): base is a locked nucleic acid
  modified_base (10)..(10): base is a locked nucleic acid
aycaatayatggatg

SEQ ID NO: 5171 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (1)..(1): base is a locked nucleic acid
  modified_base (8)..(8): base is a locked nucleic acid
  modified_base (10)..(10): base is a locked nucleic acid
caatayrtggatgay

SEQ ID NO: 5172 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (3)..(3): base is a locked nucleic acid
  modified_base (8)..(8): base is a locked nucleic acid
  modified_base (10)..(10): base is a locked nucleic acid
aycaatayatggatg

SEQ ID NO: 5173 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (4)..(4): base is a locked nucleic acid
  modified_base (8)..(8): base is a locked nucleic acid
  modified_base (10)..(10): base is a locked nucleic acid
caatayrtggatgay

SEQ ID NO: 5174 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (4)..(4): base is a locked nucleic acid
  modified_base (8)..(8): base is a locked nucleic acid
  modified_base (10)..(10): base is a locked nucleic acid
aycaatayatggatg

SEQ ID NO: 5175 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (7)..(7): base is a locked nucleic acid
  modified_base (8)..(8): base is a locked nucleic acid
  modified_base (10)..(10): base is a locked nucleic acid
caatayrtggatgay

SEQ ID NO: 5176 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
aycaatayatggatg

SEQ ID NO: 5177 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
caatayrtggatgay

SEQ ID NO: 5178 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (12)..(12): base is a locked nucleic acid
aycaatayatgga

SEQ ID NO: 5179 - DNA, 14 bp, Artificial Sequence
  Oligonucleotide probe
  misc_binding (1)..(14): Hybridization probe for the specific detection of wild-type HIV-1 at codon 184 of the reverse transcriptase gene.
caatayrtggatga

SEQ ID NO: 5180 - DNA, 14 bp, Artificial Sequence
  Oligonucleotide probe
  misc_binding (1)..(14): Hybridization probe for the specific detection of wild-type HIV-1 at codon 184 of the reverse transcriptase gene.
aycaatayatggat

SEQ ID NO: 5181 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (11)..(11): base is a locked nucleic acid
caatayrtggatg

SEQ ID NO: 5182 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (12)..(12): base is a locked nucleic acid
caatayrtggatg

SEQ ID NO: 5183 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
caatayrtggatg

SEQ ID NO: 5184 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
aycaatayatgga

SEQ ID NO: 5185 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (4)..(4): base is a locked nucleic acid
caatayrtggatg

SEQ ID NO: 5186 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (6)..(6): base is a locked nucleic acid
aycaatayatgga

SEQ ID NO: 5187 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (2)..(2): base is a locked nucleic acid
caatayrtggatg

SEQ ID NO: 5188 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (3)..(3): base is a locked nucleic acid
aycaatayatgga

SEQ ID NO: 5189 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (1)..(1): base is a locked nucleic acid
caatayrtggatg

SEQ ID NO: 5190 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (5)..(5): base is a locked nucleic acid
aycaatayatgga

SEQ ID NO: 5191 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (7)..(7): base is a locked nucleic acid
caatayrtggatg

SEQ ID NO: 5192 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (13)..(13): base is a locked nucleic acid
aycaatayatgga

SEQ ID NO: 5193 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (12)..(12): base is a locked nucleic acid
caatayrtggatg

SEQ ID NO: 5194 - DNA, 14 bp, Artificial Sequence
  Oligonucleotide probe
  misc_binding (1)..(14): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
aycaatayatggat

SEQ ID NO: 5195 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
  modified_base (13)..(13): base is a locked nucleic acid
caatayrtggatg

SEQ ID NO: 5196 - DNA, 14 bp, Artificial Sequence
  Oligonucleotide probe
  misc_binding (1)..(14): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
caatayrtggatga

SEQ ID NO: 5197 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
aycaatayatgga

SEQ ID NO: 5198 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
caatayrtggatg

SEQ ID NO: 5199 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (1)..(1): base is a locked nucleic acid
  modified_base (8)..(8): base is a locked nucleic acid
  modified_base (10)..(10): base is a locked nucleic acid
aycaatayatgga

SEQ ID NO: 5200 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (6)..(6): base is a locked nucleic acid
  modified_base (8)..(8): base is a locked nucleic acid
  modified_base (10)..(10): base is a locked nucleic acid
caatayrtggatg

SEQ ID NO: 5201 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (7)..(7): base is a locked nucleic acid
  modified_base (8)..(8): base is a locked nucleic acid
  modified_base (10)..(10): base is a locked nucleic acid
aycaatayatgga

SEQ ID NO: 5202 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (1)..(1): base is a locked nucleic acid
  modified_base (8)..(8): base is a locked nucleic acid
  modified_base (10)..(10): base is a locked nucleic acid
caatayrtggatg

SEQ ID NO: 5203 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (3)..(3): base is a locked nucleic acid
  modified_base (8)..(8): base is a locked nucleic acid
  modified_base (10)..(10): base is a locked nucleic acid
aycaatayatgga

SEQ ID NO: 5204 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (4)..(4): base is a locked nucleic acid
  modified_base (8)..(8): base is a locked nucleic acid
  modified_base (10)..(10): base is a locked nucleic acid
caatayrtggatg

SEQ ID NO: 5205 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (4)..(4): base is a locked nucleic acid
  modified_base (8)..(8): base is a locked nucleic acid
  modified_base (10)..(10): base is a locked nucleic acid
aycaatayatgga

SEQ ID NO: 5206 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (7)..(7): base is a locked nucleic acid
  modified_base (8)..(8): base is a locked nucleic acid
  modified_base (10)..(10): base is a locked nucleic acid
caatayrtggatg

SEQ ID NO: 5207 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
aycaatayatgga

SEQ ID NO: 5208 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
  modified_base (8)..(8): base is a locked nucleic acid
  modified_base (10)..(10): base is a locked nucleic acid
caatayrtggatg

SEQ ID NO: 5209 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
tcaatacatggatga

SEQ ID NO: 5210 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
taycaatayatggatgayt

SEQ ID NO: 5211 - DNA, 19 bp, Artificial Sequence
  Oligonucleotide probe
  misc_binding (1)..(19): Hybridization probe for the specific detection of wild-type HIV-1 at codon 184 of the reverse transcriptase gene.
ycaatayrtggatgayttr

SEQ ID NO: 5212 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
aycaatayatggatgay

SEQ ID NO: 5213 - DNA, 17 bp, Artificial Sequence
  Oligonucleotide probe
  misc_binding (1)..(17): Hybridization probe for the specific detection of wild-type HIV-1 at codon 184 of the reverse transcriptase gene.
caatayrtggatgaytt

SEQ ID NO: 5214 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
aycaatayatggatg

SEQ ID NO: 5215 - DNA, 15 bp, Artificial Sequence
  Oligonucleotide probe
  misc_binding (1)..(15): Hybridization probe for the specific detection of wild-type HIV-1 at codon 184 of the reverse transcriptase gene.
caatayrtggatgay

SEQ ID NO: 5216 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
aycaatayatgga

SEQ ID NO: 5217 - DNA, 13 bp, Artificial Sequence
  Oligonucleotide probe
  misc_binding (1)..(13): Hybridization probe for the specific detection of wild-type HIV-1 at codon 184 of the reverse transcriptase gene.
caatayrtggatg

SEQ ID NO: 5218 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (16)..(16): base is a locked nucleic acid
atgayttrtatgtaggmtc

SEQ ID NO: 5219 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (12)..(12): base is a locked nucleic acid
gatgayttrtatgtaggmt

SEQ ID NO: 5220 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (15)..(15): base is a locked nucleic acid
atgayttrtatgtaggmtc

SEQ ID NO: 5221 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (14)..(14): base is a locked nucleic acid
gatgayttrtatgtaggmt

SEQ ID NO: 5222 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (11)..(11): base is a locked nucleic acid
atgayttrtatgtaggmtc

SEQ ID NO: 5223 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (17)..(17): base is a locked nucleic acid
gatgayttrtatgtaggmt

SEQ ID NO: 5224 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (19)..(19): base is a locked nucleic acid
atgayttrtatgtaggmtc

SEQ ID NO: 5225 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (16)..(16): base is a locked nucleic acid
gatgayttrtatgtaggmt

SEQ ID NO: 5226 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (2)..(2): base is a locked nucleic acid
atgayttrtatgtaggmtc

SEQ ID NO: 5227 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (3)..(3): base is a locked nucleic acid
gatgayttrtatgtaggmt

SEQ ID NO: 5228 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (3)..(3): base is a locked nucleic acid
atgayttrtatgtaggmtc

SEQ ID NO: 5229 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (2)..(2): base is a locked nucleic acid
gatgayttrtatgtaggmt

SEQ ID NO: 5230 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (6)..(6): base is a locked nucleic acid
atgayttrtatgtaggmtc

SEQ ID NO: 5231 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (4)..(4): base is a locked nucleic acid
gatgayttrtatgtaggmt

SEQ ID NO: 5232 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (4)..(4): base is a locked nucleic acid
atgayttrtatgtaggmtc

SEQ ID NO: 5233 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (6)..(6): base is a locked nucleic acid
gatgayttrtatgtaggmt

SEQ ID NO: 5234 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (13)..(13): base is a locked nucleic acid
atgayttrtatgtaggmtc

SEQ ID NO: 5235 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (16)..(16): base is a locked nucleic acid
gatgayttrtatgtaggmt

SEQ ID NO: 5236 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (18)..(18): base is a locked nucleic acid
atgayttrtatgtaggmtc

SEQ ID NO: 5237 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (19)..(19): base is a locked nucleic acid
gatgayttrtatgtaggmt

SEQ ID NO: 5238 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (17)..(17): base is a locked nucleic acid
atgayttrtatgtaggmtc

SEQ ID NO: 5239 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (15)..(15): base is a locked nucleic acid
gatgayttrtatgtaggmt

SEQ ID NO: 5240 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (15)..(15): base is a locked nucleic acid
atgayttrtatgtaggmtc

SEQ ID NO: 5241 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
  modified_base (13)..(13): base is a locked nucleic acid
gatgayttrtatgtaggmt

SEQ ID NO: 5242 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
atgayttrtatgtaggmtc

SEQ ID NO: 5243 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (5)..(5): base is a locked nucleic acid
  modified_base (9)..(9): base is a locked nucleic acid
  modified_base (11)..(11): base is a locked nucleic acid
gatgayttrtatgtaggmt

SEQ ID NO: 5244 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (6)..(6): base is a locked nucleic acid
  modified_base (9)..(9): base is a locked nucleic acid
  modified_base (11)..(11): base is a locked nucleic acid
atgayttrtatgtaggmtc

SEQ ID NO: 5245 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (3)..(3): base is a locked nucleic acid
  modified_base (9)..(9): base is a locked nucleic acid
  modified_base (11)..(11): base is a locked nucleic acid
gatgayttrtatgtaggmt

SEQ ID NO: 5246 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (7)..(7): base is a locked nucleic acid
  modified_base (9)..(9): base is a locked nucleic acid
  modified_base (11)..(11): base is a locked nucleic acid
atgayttrtatgtaggmtc

SEQ ID NO: 5247 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (4)..(4): base is a locked nucleic acid
  modified_base (9)..(9): base is a locked nucleic acid
  modified_base (11)..(11): base is a locked nucleic acid
gatgayttrtatgtaggmt

SEQ ID NO: 5248 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (3)..(3): base is a locked nucleic acid
  modified_base (9)..(9): base is a locked nucleic acid
  modified_base (11)..(11): base is a locked nucleic acid
atgayttrtatgtaggmtc

SEQ ID NO: 5249 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (8)..(8): base is a locked nucleic acid
  modified_base (9)..(9): base is a locked nucleic acid
  modified_base (11)..(11): base is a locked nucleic acid
gatgayttrtatgtaggmt

SEQ ID NO: 5250 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
atgayttrtatgtaggmtc

SEQ ID NO: 5251 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
  modified_base (9)..(9): base is a locked nucleic acid
  modified_base (11)..(11): base is a locked nucleic acid
gatgayttrtatgtaggmt

SEQ ID NO: 5252 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (15)..(15): base is a locked nucleic acid
tgayttrtatgtaggmt

SEQ ID NO: 5253 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (11)..(11): base is a locked nucleic acid
atgayttrtatgtaggm

SEQ ID NO: 5254 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (14)..(14): base is a locked nucleic acid
tgayttrtatgtaggmt

SEQ ID NO: 5255 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (13)..(13): base is a locked nucleic acid
atgayttrtatgtaggm

SEQ ID NO: 5256 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (10)..(10): base is a locked nucleic acid
tgayttrtatgtaggmt

SEQ ID NO: 5257 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (16)..(16): base is a locked nucleic acid
atgayttrtatgtaggm

SEQ ID NO: 5258 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
tgayttrtatgtaggmt

SEQ ID NO: 5259 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (15)..(15): base is a locked nucleic acid
atgayttrtatgtaggm

SEQ ID NO: 5260 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (1)..(1): base is a locked nucleic acid
tgayttrtatgtaggmt

SEQ ID NO: 5261 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (2)..(2): base is a locked nucleic acid
atgayttrtatgtaggm

SEQ ID NO: 5262 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (2)..(2): base is a locked nucleic acid
tgayttrtatgtaggmt

SEQ ID NO: 5263 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (1)..(1): base is a locked nucleic acid
atgayttrtatgtaggm

SEQ ID NO: 5264 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (5)..(5): base is a locked nucleic acid
tgayttrtatgtaggmt

SEQ ID NO: 5265 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (3)..(3): base is a locked nucleic acid
atgayttrtatgtaggm

SEQ ID NO: 5266 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (3)..(3): base is a locked nucleic acid
tgayttrtatgtaggmt

SEQ ID NO: 5267 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (5)..(5): base is a locked nucleic acid
atgayttrtatgtaggm

SEQ ID NO: 5268 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (12)..(12): base is a locked nucleic acid
tgayttrtatgtaggmt

SEQ ID NO: 5269 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (15)..(15): base is a locked nucleic acid
atgayttrtatgtaggm

SEQ ID NO: 5270 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (17)..(17): base is a locked nucleic acid
tgayttrtatgtaggmt

SEQ ID NO: 5271 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
atgayttrtatgtaggm

SEQ ID NO: 5272 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (16)..(16): base is a locked nucleic acid
tgayttrtatgtaggmt

SEQ ID NO: 5273 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (14)..(14): base is a locked nucleic acid
atgayttrtatgtaggm

SEQ ID NO: 5274 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (14)..(14): base is a locked nucleic acid
tgayttrtatgtaggmt

SEQ ID NO: 5275 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (12)..(12): base is a locked nucleic acid
atgayttrtatgtaggm

SEQ ID NO: 5276 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (7)..(7): base is a locked nucleic acid
  modified_base (8)..(8): base is a locked nucleic acid
  modified_base (10)..(10): base is a locked nucleic acid
tgayttrtatgtaggmt

SEQ ID NO: 5277 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (4)..(4): base is a locked nucleic acid
  modified_base (8)..(8): base is a locked nucleic acid
  modified_base (10)..(10): base is a locked nucleic acid
atgayttrtatgtaggm

SEQ ID NO: 5278 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (5)..(5): base is a locked nucleic acid
  modified_base (8)..(8): base is a locked nucleic acid
  modified_base (10)..(10): base is a locked nucleic acid
tgayttrtatgtaggmt

SEQ ID NO: 5279 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (2)..(2): base is a locked nucleic acid
  modified_base (8)..(8): base is a locked nucleic acid
  modified_base (10)..(10): base is a locked nucleic acid
atgayttrtatgtaggm

SEQ ID NO: 5280 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (6)..(6): base is a locked nucleic acid
  modified_base (8)..(8): base is a locked nucleic acid
  modified_base (10)..(10): base is a locked nucleic acid
tgayttrtatgtaggmt

SEQ ID NO: 5281 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (3)..(3): base is a locked nucleic acid
  modified_base (8)..(8): base is a locked nucleic acid
  modified_base (10)..(10): base is a locked nucleic acid
atgayttrtatgtaggm

SEQ ID NO: 5282 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (2)..(2): base is a locked nucleic acid
  modified_base (8)..(8): base is a locked nucleic acid
  modified_base (10)..(10): base is a locked nucleic acid
tgayttrtatgtaggmt

SEQ ID NO: 5283 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (7)..(7): base is a locked nucleic acid
  modified_base (8)..(8): base is a locked nucleic acid
  modified_base (10)..(10): base is a locked nucleic acid
atgayttrtatgtaggm

SEQ ID NO: 5284 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
tgayttrtatgtaggmt

SEQ ID NO: 5285 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
atgayttrtatgtaggm

SEQ ID NO: 5286 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (15)..(15): base is a locked nucleic acid
tgayttrtatgtagg

SEQ ID NO: 5287 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (11)..(11): base is a locked nucleic acid
atgayttrtatgtag

SEQ ID NO: 5288 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (14)..(14): base is a locked nucleic acid
tgayttrtatgtagg

SEQ ID NO: 5289 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (13)..(13): base is a locked nucleic acid
atgayttrtatgtag

SEQ ID NO: 5290 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (10)..(10): base is a locked nucleic acid
tgayttrtatgtagg

SEQ ID NO: 5291 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
atgayttrtatgtag

SEQ ID NO: 5292 - DNA, 16 bp, Artificial Sequence
  Oligonucleotide probe
  misc_binding (1)..(16): Hybridization probe for the specific detection of wild-type HIV-1 at codon 188 of the reverse transcriptase gene.
tgayttrtatgtaggm

SEQ ID NO: 5293 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (15)..(15): base is a locked nucleic acid
atgayttrtatgtag

SEQ ID NO: 5294 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (1)..(1): base is a locked nucleic acid
tgayttrtatgtagg

SEQ ID NO: 5295 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (2)..(2): base is a locked nucleic acid
atgayttrtatgtag

SEQ ID NO: 5296 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (2)..(2): base is a locked nucleic acid
tgayttrtatgtagg

SEQ ID NO: 5297 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (1)..(1): base is a locked nucleic acid
atgayttrtatgtag

SEQ ID NO: 5298 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (5)..(5): base is a locked nucleic acid
tgayttrtatgtagg

SEQ ID NO: 5299 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (3)..(3): base is a locked nucleic acid
atgayttrtatgtag

SEQ ID NO: 5300 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (3)..(3): base is a locked nucleic acid
tgayttrtatgtagg

SEQ ID NO: 5301 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (5)..(5): base is a locked nucleic acid
atgayttrtatgtag

SEQ ID NO: 5302 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (12)..(12): base is a locked nucleic acid
tgayttrtatgtagg

SEQ ID NO: 5303 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (15)..(15): base is a locked nucleic acid
atgayttrtatgtag

SEQ ID NO: 5304 - DNA, 16 bp, Artificial Sequence
  Oligonucleotide probe
  misc_binding (1)..(16): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
tgayttrtatgtaggm

SEQ ID NO: 5305 - DNA, 16 bp, Artificial Sequence
  Oligonucleotide probe
  misc_binding (1)..(16): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
atgayttrtatgtagg

SEQ ID NO: 5306 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
tgayttrtatgtagg

SEQ ID NO: 5307 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (14)..(14): base is a locked nucleic acid
atgayttrtatgtag

SEQ ID NO: 5308 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (14)..(14): base is a locked nucleic acid
tgayttrtatgtagg

SEQ ID NO: 5309 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (12)..(12): base is a locked nucleic acid
atgayttrtatgtag

SEQ ID NO: 5310 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (7)..(7): base is a locked nucleic acid
  modified_base (8)..(8): base is a locked nucleic acid
  modified_base (10)..(10): base is a locked nucleic acid
tgayttrtatgtagg

SEQ ID NO: 5311 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (4)..(4): base is a locked nucleic acid
  modified_base (8)..(8): base is a locked nucleic acid
  modified_base (10)..(10): base is a locked nucleic acid
atgayttrtatgtag

SEQ ID NO: 5312 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (5)..(5): base is a locked nucleic acid
  modified_base (8)..(8): base is a locked nucleic acid
  modified_base (10)..(10): base is a locked nucleic acid
tgayttrtatgtagg

SEQ ID NO: 5313 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (2)..(2): base is a locked nucleic acid
  modified_base (8)..(8): base is a locked nucleic acid
  modified_base (10)..(10): base is a locked nucleic acid
atgayttrtatgtag

SEQ ID NO: 5314 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (6)..(6): base is a locked nucleic acid
  modified_base (8)..(8): base is a locked nucleic acid
  modified_base (10)..(10): base is a locked nucleic acid
tgayttrtatgtagg

SEQ ID NO: 5315 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (3)..(3): base is a locked nucleic acid
  modified_base (8)..(8): base is a locked nucleic acid
  modified_base (10)..(10): base is a locked nucleic acid
atgayttrtatgtag

SEQ ID NO: 5316 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (2)..(2): base is a locked nucleic acid
  modified_base (8)..(8): base is a locked nucleic acid
  modified_base (10)..(10): base is a locked nucleic acid
tgayttrtatgtagg

SEQ ID NO: 5317 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (7)..(7): base is a locked nucleic acid
  modified_base (8)..(8): base is a locked nucleic acid
  modified_base (10)..(10): base is a locked nucleic acid
atgayttrtatgtag

SEQ ID NO: 5318 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
tgayttrtatgtagg

SEQ ID NO: 5319 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
atgayttrtatgtag

SEQ ID NO: 5320 - DNA, 14 bp, Artificial Sequence
  Oligonucleotide probe
  misc_binding (1)..(14): Hybridization probe for the specific detection of wild-type HIV-1 at codon 188 of the reverse transcriptase gene.
tgayttrtatgtag

SEQ ID NO: 5321 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (11)..(11): base is a locked nucleic acid
atgayttrtatgt

SEQ ID NO: 5322 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
tgayttrtatgta

SEQ ID NO: 5323 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (13)..(13): base is a locked nucleic acid
atgayttrtatgt

SEQ ID NO: 5324 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (10)..(10): base is a locked nucleic acid
tgayttrtatgta

SEQ ID NO: 5325 - DNA, 14 bp, Artificial Sequence
  Oligonucleotide probe
  misc_binding (1)..(14): Hybridization probe for the specific detection of wild-type HIV-1 at codon 188 of the reverse transcriptase gene.
atgayttrtatgta

SEQ ID NO: 5326 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (1)..(1): base is a locked nucleic acid
tgayttrtatgta

SEQ ID NO: 5327 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (2)..(2): base is a locked nucleic acid
atgayttrtatgt

SEQ ID NO: 5328 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (2)..(2): base is a locked nucleic acid
tgayttrtatgta

SEQ ID NO: 5329 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (1)..(1): base is a locked nucleic acid
atgayttrtatgt

SEQ ID NO: 5330 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (5)..(5): base is a locked nucleic acid
tgayttrtatgta

SEQ ID NO: 5331 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (3)..(3): base is a locked nucleic acid
atgayttrtatgt

SEQ ID NO: 5332 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (3)..(3): base is a locked nucleic acid
tgayttrtatgta

SEQ ID NO: 5333 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (5)..(5): base is a locked nucleic acid
atgayttrtatgt

SEQ ID NO: 5334 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (12)..(12): base is a locked nucleic acid
tgayttrtatgta

SEQ ID NO: 5335 - DNA, 14 bp, Artificial Sequence
  Oligonucleotide probe
  misc_binding (1)..(14): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
atgayttrtatgta

SEQ ID NO: 5336 - DNA, 14 bp, Artificial Sequence
  Oligonucleotide probe
  misc_binding (1)..(14): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
tgayttrtatgtag

SEQ ID NO: 5337 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
atgayttrtatgt

SEQ ID NO: 5338 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
tgayttrtatgta

SEQ ID NO: 5339 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
  modified_base (12)..(12): base is a locked nucleic acid
atgayttrtatgt

SEQ ID NO: 5340 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (7)..(7): base is a locked nucleic acid
  modified_base (8)..(8): base is a locked nucleic acid
  modified_base (10)..(10): base is a locked nucleic acid
tgayttrtatgta

SEQ ID NO: 5341 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (4)..(4): base is a locked nucleic acid
  modified_base (8)..(8): base is a locked nucleic acid
  modified_base (10)..(10): base is a locked nucleic acid
atgayttrtatgt

SEQ ID NO: 5342 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (5)..(5): base is a locked nucleic acid
  modified_base (8)..(8): base is a locked nucleic acid
  modified_base (10)..(10): base is a locked nucleic acid
tgayttrtatgta

SEQ ID NO: 5343 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (2)..(2): base is a locked nucleic acid
  modified_base (8)..(8): base is a locked nucleic acid
  modified_base (10)..(10): base is a locked nucleic acid
atgayttrtatgt

SEQ ID NO: 5344 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (6)..(6): base is a locked nucleic acid
  modified_base (8)..(8): base is a locked nucleic acid
  modified_base (10)..(10): base is a locked nucleic acid
tgayttrtatgta

SEQ ID NO: 5345 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (3)..(3): base is a locked nucleic acid
  modified_base (8)..(8): base is a locked nucleic acid
  modified_base (10)..(10): base is a locked nucleic acid
atgayttrtatgt

SEQ ID NO: 5346 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (2)..(2): base is a locked nucleic acid
  modified_base (8)..(8): base is a locked nucleic acid
  modified_base (10)..(10): base is a locked nucleic acid
tgayttrtatgta

SEQ ID NO: 5347 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (7)..(7): base is a locked nucleic acid
  modified_base (8)..(8): base is a locked nucleic acid
  modified_base (10)..(10): base is a locked nucleic acid
atgayttrtatgt

SEQ ID NO: 5348 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
tgayttrtatgta

SEQ ID NO: 5349 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
  modified_base (8)..(8): base is a locked nucleic acid
  modified_base (10)..(10): base is a locked nucleic acid
atgayttrtatgt

SEQ ID NO: 5350 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
tcctacatacaaatc

SEQ ID NO: 5351 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
atgayttrtatgtaggmtc

SEQ ID NO: 5352 - DNA, 19 bp, Artificial Sequence
  Oligonucleotide probe
  misc_binding (1)..(19): Hybridization probe for the specific detection of wild-type HIV-1 at codon 188 of the reverse transcriptase gene.
gatgayttrtatgtaggmt

SEQ ID NO: 5353 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
tgayttrtatgtaggmt

SEQ ID NO: 5354 - DNA, 17 bp, Artificial Sequence
  Oligonucleotide probe
  misc_binding (1)..(17): Hybridization probe for the specific detection of wild-type HIV-1 at codon 188 of the reverse transcriptase gene.
atgayttrtatgtaggm

SEQ ID NO: 5355 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
tgayttrtatgtagg

SEQ ID NO: 5356 - DNA, 15 bp, Artificial Sequence
  Oligonucleotide probe
  misc_binding (1)..(15): Hybridization probe for the specific detection of wild-type HIV-1 at codon 188 of the reverse transcriptase gene.
atgayttrtatgtag

SEQ ID NO: 5357 - DNA, 16 bp, Artificial Sequence
  Oligonucleotide probe
  misc_binding (1)..(16): Hybridization probe for the specific detection of wild-type HIV-1 at codon 188 of the reverse transcriptase gene.
atgayttrtatgtagg

SEQ ID NO: 5358 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
atgayttrtatgt

SEQ ID NO: 5359 - DNA, 13 bp, Artificial Sequence
  Oligonucleotide probe
  misc_binding (1)..(13): Hybridization probe for the specific detection of wild-type HIV-1 at codon 188 of the reverse transcriptase gene.
tgayttrtatgta

SEQ ID NO: 5360 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (15)..(15): base is a locked nucleic acid
trtatgtaggmtcwgaytt

SEQ ID NO: 5361 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (13)..(13): base is a locked nucleic acid
trtatgtaggmtcwgaytt

SEQ ID NO: 5362 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (12)..(12): base is a locked nucleic acid
ttrtatgtaggmtcwgayt

SEQ ID NO: 5363 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (12)..(12): base is a locked nucleic acid
trtatgtaggmtcwgaytt

SEQ ID NO: 5364 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (11)..(11): base is a locked nucleic acid
trtatgtaggmtcwgaytt

SEQ ID NO: 5365 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (14)..(14): base is a locked nucleic acid
ttrtatgtaggmtcwgayt

SEQ ID NO: 5366 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (14)..(14): base is a locked nucleic acid
trtatgtaggmtcwgaytt

SEQ ID NO: 5367 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (18)..(18): base is a locked nucleic acid
ttrtatgtaggmtcwgayt

SEQ ID NO: 5368 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (16)..(16): base is a locked nucleic acid
trtatgtaggmtcwgaytt

SEQ ID NO: 5369 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (17)..(17): base is a locked nucleic acid
trtatgtaggmtcwgaytt

SEQ ID NO: 5370 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (16)..(16): base is a locked nucleic acid
ttrtatgtaggmtcwgayt

SEQ ID NO: 5371 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (2)..(2): base is a locked nucleic acid
trtatgtaggmtcwgaytt

SEQ ID NO: 5372 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (8)..(8): base is a locked nucleic acid
trtatgtaggmtcwgaytt

SEQ ID NO: 5373 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
ttrtatgtaggmtcwgayt

SEQ ID NO: 5374 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
trtatgtaggmtcwgaytt

SEQ ID NO: 5375 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (8)..(8): base is a locked nucleic acid
ttrtatgtaggmtcwgayt

SEQ ID NO: 5376 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (4)..(4): base is a locked nucleic acid
trtatgtaggmtcwgaytt

SEQ ID NO: 5377 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (6)..(6): base is a locked nucleic acid
trtatgtaggmtcwgaytt

SEQ ID NO: 5378 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (4)..(4): base is a locked nucleic acid
ttrtatgtaggmtcwgayt

SEQ ID NO: 5379 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (3)..(3): base is a locked nucleic acid
trtatgtaggmtcwgaytt

SEQ ID NO: 5380 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (6)..(6): base is a locked nucleic acid
ttrtatgtaggmtcwgayt

SEQ ID NO: 5381 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (15)..(15): base is a locked nucleic acid
trtatgtaggmtcwgaytt

SEQ ID NO: 5382 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (19)..(19): base is a locked nucleic acid
trtatgtaggmtcwgaytt

SEQ ID NO: 5383 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (17)..(17): base is a locked nucleic acid
ttrtatgtaggmtcwgayt

SEQ ID NO: 5384 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (13)..(13): base is a locked nucleic acid
trtatgtaggmtcwgaytt

SEQ ID NO: 5385 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (17)..(17): base is a locked nucleic acid
trtatgtaggmtcwgaytt

SEQ ID NO: 5386 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (16)..(16): base is a locked nucleic acid
ttrtatgtaggmtcwgayt

SEQ ID NO: 5387 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (14)..(14): base is a locked nucleic acid
trtatgtaggmtcwgaytt

SEQ ID NO: 5388 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (16)..(16): base is a locked nucleic acid
trtatgtaggmtcwgaytt

SEQ ID NO: 5389 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (12)..(12): base is a locked nucleic acid
ttrtatgtaggmtcwgayt

SEQ ID NO: 5390 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (12)..(12): base is a locked nucleic acid
trtatgtaggmtcwgaytt

SEQ ID NO: 5391 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
  modified_base (14)..(14): base is a locked nucleic acid
ttrtatgtaggmtcwgayt

SEQ ID NO: 5392 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (7)..(7): base is a locked nucleic acid
  modified_base (9)..(9): base is a locked nucleic acid
  modified_base (11)..(11): base is a locked nucleic acid
trtatgtaggmtcwgaytt

SEQ ID NO: 5393 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (5)..(5): base is a locked nucleic acid
  modified_base (9)..(9): base is a locked nucleic acid
  modified_base (11)..(11): base is a locked nucleic acid
trtatgtaggmtcwgaytt

SEQ ID NO: 5394 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (2)..(2): base is a locked nucleic acid
  modified_base (9)..(9): base is a locked nucleic acid
  modified_base (11)..(11): base is a locked nucleic acid
ttrtatgtaggmtcwgayt

SEQ ID NO: 5395 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (6)..(6): base is a locked nucleic acid
  modified_base (9)..(9): base is a locked nucleic acid
  modified_base (11)..(11): base is a locked nucleic acid
trtatgtaggmtcwgaytt

SEQ ID NO: 5396 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (3)..(3): base is a locked nucleic acid
  modified_base (9)..(9): base is a locked nucleic acid
  modified_base (11)..(11): base is a locked nucleic acid
trtatgtaggmtcwgaytt

SEQ ID NO: 5397 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (7)..(7): base is a locked nucleic acid
  modified_base (9)..(9): base is a locked nucleic acid
  modified_base (11)..(11): base is a locked nucleic acid
ttrtatgtaggmtcwgayt

SEQ ID NO: 5398 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (3)..(3): base is a locked nucleic acid
  modified_base (9)..(9): base is a locked nucleic acid
  modified_base (11)..(11): base is a locked nucleic acid
ttrtatgtaggmtcwgayt

SEQ ID NO: 5399 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (4)..(4): base is a locked nucleic acid
  modified_base (9)..(9): base is a locked nucleic acid
  modified_base (11)..(11): base is a locked nucleic acid
trtatgtaggmtcwgaytt

SEQ ID NO: 5400 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (8)..(8): base is a locked nucleic acid
  modified_base (9)..(9): base is a locked nucleic acid
  modified_base (11)..(11): base is a locked nucleic acid
ttrtatgtaggmtcwgayt

SEQ ID NO: 5401 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
trtatgtaggmtcwgaytt

SEQ ID NO: 5402 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
  modified_base (9)..(9): base is a locked nucleic acid
  modified_base (11)..(11): base is a locked nucleic acid
ttrtatgtaggmtcwgayt

SEQ ID NO: 5403 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (14)..(14): base is a locked nucleic acid
rtatgtaggmtcwgayt

SEQ ID NO: 5404 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (12)..(12): base is a locked nucleic acid
rtatgtaggmtcwgayt

SEQ ID NO: 5405 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (11)..(11): base is a locked nucleic acid
trtatgtaggmtcwgay

SEQ ID NO: 5406 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (11)..(11): base is a locked nucleic acid
rtatgtaggmtcwgayt

SEQ ID NO: 5407 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (10)..(10): base is a locked nucleic acid
rtatgtaggmtcwgayt

SEQ ID NO: 5408 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (13)..(13): base is a locked nucleic acid
trtatgtaggmtcwgay

SEQ ID NO: 5409 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (13)..(13): base is a locked nucleic acid
rtatgtaggmtcwgayt

SEQ ID NO: 5410 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (17)..(17): base is a locked nucleic acid
trtatgtaggmtcwgay

SEQ ID NO: 5411 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (15)..(15): base is a locked nucleic acid
rtatgtaggmtcwgayt

SEQ ID NO: 5412 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (16)..(16): base is a locked nucleic acid
rtatgtaggmtcwgayt

SEQ ID NO: 5413 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (15)..(15): base is a locked nucleic acid
trtatgtaggmtcwgay

SEQ ID NO: 5414 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (1)..(1): base is a locked nucleic acid
rtatgtaggmtcwgayt

SEQ ID NO: 5415 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (7)..(7): base is a locked nucleic acid
rtatgtaggmtcwgayt

SEQ ID NO: 5416 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
trtatgtaggmtcwgay

SEQ ID NO: 5417 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
rtatgtaggmtcwgayt

SEQ ID NO: 5418 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (7)..(7): base is a locked nucleic acid
trtatgtaggmtcwgay

SEQ ID NO: 5419 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (3)..(3): base is a locked nucleic acid
rtatgtaggmtcwgayt

SEQ ID NO: 5420 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (5)..(5): base is a locked nucleic acid
rtatgtaggmtcwgayt

SEQ ID NO: 5421 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (3)..(3): base is a locked nucleic acid
trtatgtaggmtcwgay

SEQ ID NO: 5422 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (2)..(2): base is a locked nucleic acid
rtatgtaggmtcwgayt

SEQ ID NO: 5423 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (5)..(5): base is a locked nucleic acid
trtatgtaggmtcwgay

SEQ ID NO: 5424 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (14)..(14): base is a locked nucleic acid
rtatgtaggmtcwgayt

SEQ ID NO: 5425 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcwgayt

SEQ ID NO: 5426 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (16)..(16): base is a locked nucleic acid
trtatgtaggmtcwgay

SEQ ID NO: 5427 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (12)..(12): base is a locked nucleic acid
rtatgtaggmtcwgayt

SEQ ID NO: 5428 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (16)..(16): base is a locked nucleic acid
rtatgtaggmtcwgayt

SEQ ID NO: 5429 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (15)..(15): base is a locked nucleic acid
trtatgtaggmtcwgay

SEQ ID NO: 5430 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (13)..(13): base is a locked nucleic acid
rtatgtaggmtcwgayt

SEQ ID NO: 5431 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (15)..(15): base is a locked nucleic acid
rtatgtaggmtcwgayt

SEQ ID NO: 5432 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (11)..(11): base is a locked nucleic acid
trtatgtaggmtcwgay

SEQ ID NO: 5433 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (11)..(11): base is a locked nucleic acid
rtatgtaggmtcwgayt

SEQ ID NO: 5434 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (13)..(13): base is a locked nucleic acid
trtatgtaggmtcwgay

SEQ ID NO: 5435 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (6)..(6): base is a locked nucleic acid
  modified_base (8)..(8): base is a locked nucleic acid
  modified_base (10)..(10): base is a locked nucleic acid
rtatgtaggmtcwgayt

SEQ ID NO: 5436 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (4)..(4): base is a locked nucleic acid
  modified_base (8)..(8): base is a locked nucleic acid
  modified_base (10)..(10): base is a locked nucleic acid
rtatgtaggmtcwgayt

SEQ ID NO: 5437 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (1)..(1): base is a locked nucleic acid
  modified_base (8)..(8): base is a locked nucleic acid
  modified_base (10)..(10): base is a locked nucleic acid
trtatgtaggmtcwgay

SEQ ID NO: 5438 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (5)..(5): base is a locked nucleic acid
  modified_base (8)..(8): base is a locked nucleic acid
  modified_base (10)..(10): base is a locked nucleic acid
rtatgtaggmtcwgayt

SEQ ID NO: 5439 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (2)..(2): base is a locked nucleic acid
  modified_base (8)..(8): base is a locked nucleic acid
  modified_base (10)..(10): base is a locked nucleic acid
rtatgtaggmtcwgayt

SEQ ID NO: 5440 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (6)..(6): base is a locked nucleic acid
  modified_base (8)..(8): base is a locked nucleic acid
  modified_base (10)..(10): base is a locked nucleic acid
trtatgtaggmtcwgay

SEQ ID NO: 5441 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (2)..(2): base is a locked nucleic acid
  modified_base (8)..(8): base is a locked nucleic acid
  modified_base (10)..(10): base is a locked nucleic acid
trtatgtaggmtcwgay

SEQ ID NO: 5442 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (3)..(3): base is a locked nucleic acid
  modified_base (8)..(8): base is a locked nucleic acid
  modified_base (10)..(10): base is a locked nucleic acid
rtatgtaggmtcwgayt

SEQ ID NO: 5443 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (7)..(7): base is a locked nucleic acid
  modified_base (8)..(8): base is a locked nucleic acid
  modified_base (10)..(10): base is a locked nucleic acid
trtatgtaggmtcwgay

SEQ ID NO: 5444 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcwgayt

SEQ ID NO: 5445 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
trtatgtaggmtcwgay

SEQ ID NO: 5446 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (14)..(14): base is a locked nucleic acid
rtatgtaggmtcwga

SEQ ID NO: 5447 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (12)..(12): base is a locked nucleic acid
rtatgtaggmtcwga

SEQ ID NO: 5448 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (11)..(11): base is a locked nucleic acid
trtatgtaggmtcwg

SEQ ID NO: 5449 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (11)..(11): base is a locked nucleic acid
rtatgtaggmtcwga

SEQ ID NO: 5450 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (10)..(10): base is a locked nucleic acid
rtatgtaggmtcwga

SEQ ID NO: 5451 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (13)..(13): base is a locked nucleic acid
trtatgtaggmtcwg

SEQ ID NO: 5452 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (13)..(13): base is a locked nucleic acid
rtatgtaggmtcwga

SEQ ID NO: 5453 - DNA, 16 bp, Artificial Sequence
  Oligonucleotide probe
  misc_binding (1)..(16): Hybridization probe for the specific detection of wild-type HIV-1 at codon 190 of the reverse transcriptase gene.
trtatgtaggmtcwga

SEQ ID NO: 5454 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (15)..(15): base is a locked nucleic acid
rtatgtaggmtcwga

SEQ ID NO: 5455 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
rtatgtaggmtcwga

SEQ ID NO: 5456 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (15)..(15): base is a locked nucleic acid
trtatgtaggmtcwg

SEQ ID NO: 5457 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (1)..(1): base is a locked nucleic acid
rtatgtaggmtcwga

SEQ ID NO: 5458 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (7)..(7): base is a locked nucleic acid
rtatgtaggmtcwga

SEQ ID NO: 5459 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
trtatgtaggmtcwg

SEQ ID NO: 5460 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
rtatgtaggmtcwga

SEQ ID NO: 5461 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (7)..(7): base is a locked nucleic acid
trtatgtaggmtcwg

SEQ ID NO: 5462 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (3)..(3): base is a locked nucleic acid
rtatgtaggmtcwga

SEQ ID NO: 5463 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (5)..(5): base is a locked nucleic acid
rtatgtaggmtcwga

SEQ ID NO: 5464 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (3)..(3): base is a locked nucleic acid
trtatgtaggmtcwg

SEQ ID NO: 5465 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (2)..(2): base is a locked nucleic acid
rtatgtaggmtcwga

SEQ ID NO: 5466 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (5)..(5): base is a locked nucleic acid
trtatgtaggmtcwg

SEQ ID NO: 5467 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (14)..(14): base is a locked nucleic acid
rtatgtaggmtcwga

SEQ ID NO: 5468 - DNA, 16 bp, Artificial Sequence
  Oligonucleotide probe
  misc_binding (1)..(16): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcwgay

SEQ ID NO: 5469 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
trtatgtaggmtcwg

SEQ ID NO: 5470 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (12)..(12): base is a locked nucleic acid
rtatgtaggmtcwga

SEQ ID NO: 5471 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcwga

SEQ ID NO: 5472 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (15)..(15): base is a locked nucleic acid
trtatgtaggmtcwg

SEQ ID NO: 5473 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (13)..(13): base is a locked nucleic acid
rtatgtaggmtcwga

SEQ ID NO: 5474 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (15)..(15): base is a locked nucleic acid
rtatgtaggmtcwga

SEQ ID NO: 5475 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (11)..(11): base is a locked nucleic acid
trtatgtaggmtcwg

SEQ ID NO: 5476 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (11)..(11): base is a locked nucleic acid
rtatgtaggmtcwga

SEQ ID NO: 5477 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (13)..(13): base is a locked nucleic acid
trtatgtaggmtcwg

SEQ ID NO: 5478 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (6)..(6): base is a locked nucleic acid
  modified_base (8)..(8): base is a locked nucleic acid
  modified_base (10)..(10): base is a locked nucleic acid
rtatgtaggmtcwga

SEQ ID NO: 5479 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (4)..(4): base is a locked nucleic acid
  modified_base (8)..(8): base is a locked nucleic acid
  modified_base (10)..(10): base is a locked nucleic acid
rtatgtaggmtcwga

SEQ ID NO: 5480 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (1)..(1): base is a locked nucleic acid
  modified_base (8)..(8): base is a locked nucleic acid
  modified_base (10)..(10): base is a locked nucleic acid
trtatgtaggmtcwg

SEQ ID NO: 5481 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (5)..(5): base is a locked nucleic acid
  modified_base (8)..(8): base is a locked nucleic acid
  modified_base (10)..(10): base is a locked nucleic acid
rtatgtaggmtcwga

SEQ ID NO: 5482 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (2)..(2): base is a locked nucleic acid
  modified_base (8)..(8): base is a locked nucleic acid
  modified_base (10)..(10): base is a locked nucleic acid
rtatgtaggmtcwga

SEQ ID NO: 5483 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (6)..(6): base is a locked nucleic acid
  modified_base (8)..(8): base is a locked nucleic acid
  modified_base (10)..(10): base is a locked nucleic acid
trtatgtaggmtcwg

SEQ ID NO: 5484 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (2)..(2): base is a locked nucleic acid
  modified_base (8)..(8): base is a locked nucleic acid
  modified_base (10)..(10): base is a locked nucleic acid
trtatgtaggmtcwg

SEQ ID NO: 5485 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (3)..(3): base is a locked nucleic acid
  modified_base (8)..(8): base is a locked nucleic acid
  modified_base (10)..(10): base is a locked nucleic acid
rtatgtaggmtcwga

SEQ ID NO: 5486 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (7)..(7): base is a locked nucleic acid
  modified_base (8)..(8): base is a locked nucleic acid
  modified_base (10)..(10): base is a locked nucleic acid
trtatgtaggmtcwg

SEQ ID NO: 5487 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcwga

SEQ ID NO: 5488 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
trtatgtaggmtcwg

SEQ ID NO: 5489 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
rtatgtaggmtcw

SEQ ID NO: 5490 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (12)..(12): base is a locked nucleic acid
rtatgtaggmtcw

SEQ ID NO: 5491 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (11)..(11): base is a locked nucleic acid
trtatgtaggmtc

SEQ ID NO: 5492 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (11)..(11): base is a locked nucleic acid
rtatgtaggmtcw

SEQ ID NO: 5493 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (10)..(10): base is a locked nucleic acid
rtatgtaggmtcw

SEQ ID NO: 5494 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (13)..(13): base is a locked nucleic acid
trtatgtaggmtc

SEQ ID NO: 5495 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (13)..(13): base is a locked nucleic acid
rtatgtaggmtcw

SEQ ID NO: 5496 - DNA, 14 bp, Artificial Sequence
  Oligonucleotide probe
  misc_binding (1)..(14): Hybridization probe for the specific detection of wild-type HIV-1 at codon 190 of the reverse transcriptase gene.
trtatgtaggmtcw

SEQ ID NO: 5497 - DNA, 14 bp, Artificial Sequence
  Oligonucleotide probe
  misc_binding (1)..(14): Hybridization probe for the specific detection of wild-type HIV-1 at codon 190 of the reverse transcriptase gene.
rtatgtaggmtcwg

SEQ ID NO: 5498 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (1)..(1): base is a locked nucleic acid
rtatgtaggmtcw

SEQ ID NO: 5499 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (7)..(7): base is a locked nucleic acid
rtatgtaggmtcw

SEQ ID NO: 5500 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
trtatgtaggmtc

SEQ ID NO: 5501 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
rtatgtaggmtcw

SEQ ID NO: 5502 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (7)..(7): base is a locked nucleic acid
trtatgtaggmtc

SEQ ID NO: 5503 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (3)..(3): base is a locked nucleic acid
rtatgtaggmtcw

SEQ ID NO: 5504 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (5)..(5): base is a locked nucleic acid
rtatgtaggmtcw

SEQ ID NO: 5505 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (3)..(3): base is a locked nucleic acid
trtatgtaggmtc

SEQ ID NO: 5506 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (2)..(2): base is a locked nucleic acid
rtatgtaggmtcw

SEQ ID NO: 5507 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (5)..(5): base is a locked nucleic acid
trtatgtaggmtc

SEQ ID NO: 5508 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcw

SEQ ID NO: 5509 - DNA, 14 bp, Artificial Sequence
  Oligonucleotide probe
  misc_binding (1)..(14): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcwg

SEQ ID NO: 5510 - DNA, 14 bp, Artificial Sequence
  Oligonucleotide probe
  misc_binding (1)..(14): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
trtatgtaggmtcw

SEQ ID NO: 5511 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (12)..(12): base is a locked nucleic acid
rtatgtaggmtcw

SEQ ID NO: 5512 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (13)..(13): base is a locked nucleic acid
rtatgtaggmtcw

SEQ ID NO: 5513 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (11)..(11): base is a locked nucleic acid
trtatgtaggmtc

SEQ ID NO: 5514 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (11)..(11): base is a locked nucleic acid
rtatgtaggmtcw

SEQ ID NO: 5515 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
  modified_base (13)..(13): base is a locked nucleic acid
trtatgtaggmtc

SEQ ID NO: 5516 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (6)..(6): base is a locked nucleic acid
  modified_base (8)..(8): base is a locked nucleic acid
  modified_base (10)..(10): base is a locked nucleic acid
rtatgtaggmtcw

SEQ ID NO: 5517 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (4)..(4): base is a locked nucleic acid
  modified_base (8)..(8): base is a locked nucleic acid
  modified_base (10)..(10): base is a locked nucleic acid
rtatgtaggmtcw

SEQ ID NO: 5518 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (1)..(1): base is a locked nucleic acid
  modified_base (8)..(8): base is a locked nucleic acid
  modified_base (10)..(10): base is a locked nucleic acid
trtatgtaggmtc

SEQ ID NO: 5519 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (5)..(5): base is a locked nucleic acid
  modified_base (8)..(8): base is a locked nucleic acid
  modified_base (10)..(10): base is a locked nucleic acid
rtatgtaggmtcw

SEQ ID NO: 5520 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (2)..(2): base is a locked nucleic acid
  modified_base (8)..(8): base is a locked nucleic acid
  modified_base (10)..(10): base is a locked nucleic acid
rtatgtaggmtcw

SEQ ID NO: 5521 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (6)..(6): base is a locked nucleic acid
  modified_base (8)..(8): base is a locked nucleic acid
  modified_base (10)..(10): base is a locked nucleic acid
trtatgtaggmtc

SEQ ID NO: 5522 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (2)..(2): base is a locked nucleic acid
  modified_base (8)..(8): base is a locked nucleic acid
  modified_base (10)..(10): base is a locked nucleic acid
trtatgtaggmtc

SEQ ID NO: 5523 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (3)..(3): base is a locked nucleic acid
  modified_base (8)..(8): base is a locked nucleic acid
  modified_base (10)..(10): base is a locked nucleic acid
rtatgtaggmtcw

SEQ ID NO: 5524 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (7)..(7): base is a locked nucleic acid
  modified_base (8)..(8): base is a locked nucleic acid
  modified_base (10)..(10): base is a locked nucleic acid
trtatgtaggmtc

SEQ ID NO: 5525 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
rtatgtaggmtcw

SEQ ID NO: 5526 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
  modified_base (8)..(8): base is a locked nucleic acid
  modified_base (10)..(10): base is a locked nucleic acid
trtatgtaggmtc

SEQ ID NO: 5527 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
  misc_feature (9)..(9): n is a, c, g, or t
tatgtaggntctgac

SEQ ID NO: 5528 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
trtatgtaggmtcwgaytt

SEQ ID NO: 5529 - DNA, 19 bp, Artificial Sequence
  Oligonucleotide probe
  misc_binding (1)..(19): Hybridization probe for the specific detection of wild-type HIV-1 at codon 190 of the reverse transcriptase gene.
ttrtatgtaggmtcwgayt

SEQ ID NO: 5530 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
rtatgtaggmtcwgayt

SEQ ID NO: 5531 - DNA, 17 bp, Artificial Sequence
  Oligonucleotide probe
  misc_binding (1)..(17): Hybridization probe for the specific detection of wild-type HIV-1 at codon 190 of the reverse transcriptase gene.
trtatgtaggmtcwgay

SEQ ID NO: 5532 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
rtatgtaggmtcwga

SEQ ID NO: 5533 - DNA, 15 bp, Artificial Sequence
  Oligonucleotide probe
  misc_binding (1)..(15): Hybridization probe for the specific detection of wild-type HIV-1 at codon 190 of the reverse transcriptase gene.
trtatgtaggmtcwg

SEQ ID NO: 5534 - DNA, 16 bp, Artificial Sequence
  Oligonucleotide probe
  misc_binding (1)..(16): Hybridization probe for the specific detection of wild-type HIV-1 at codon 190 of the reverse transcriptase gene.
rtatgtaggmtcwgay

SEQ ID NO: 5535 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
rtatgtaggmtcw

SEQ ID NO: 5536 - DNA, 13 bp, Artificial Sequence
  Oligonucleotide probe
  misc_binding (1)..(13): Hybridization probe for the specific detection of wild-type HIV-1 at codon 190 of the reverse transcriptase gene.
trtatgtaggmtc

SEQ ID NO: 5537 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (13)..(13): base is a locked nucleic acid
mdcayytrytrarvtgggg

SEQ ID NO: 5538 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (17)..(17): base is a locked nucleic acid
mdcayytrytrarvtgggg

SEQ ID NO: 5539 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (16)..(16): base is a locked nucleic acid
mdcayytrytrarvtgggg

SEQ ID NO: 5540 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (15)..(15): base is a locked nucleic acid
mdcayytrytrarvtgggg

SEQ ID NO: 5541 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (8)..(8): base is a locked nucleic acid
mdcayytrytrarvtgggg

SEQ ID NO: 5542 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (3)..(3): base is a locked nucleic acid
mdcayytrytrarvtgggg

SEQ ID NO: 5543 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (9)..(9): base is a locked nucleic acid
mdcayytrytrarvtgggg

SEQ ID NO: 5544 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (5)..(5): base is a locked nucleic acid
mdcayytrytrarvtgggg

SEQ ID NO: 5545 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (9)..(9): base is a locked nucleic acid
  modified_base (11)..(11): base is a locked nucleic acid
  modified_base (18)..(18): base is a locked nucleic acid
mdcayytrytrarvtgggg

SEQ ID NO: 5546 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (9)..(9): base is a locked nucleic acid
  modified_base (11)..(11): base is a locked nucleic acid
  modified_base (14)..(14): base is a locked nucleic acid
mdcayytrytrarvtgggg

SEQ ID NO: 5547 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (9)..(9): base is a locked nucleic acid
  modified_base (11)..(11): base is a locked nucleic acid
  modified_base (16)..(16): base is a locked nucleic acid
mdcayytrytrarvtgggg

SEQ ID NO: 5548 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (9)..(9): base is a locked nucleic acid
  modified_base (11)..(11): base is a locked nucleic acid
  modified_base (13)..(13): base is a locked nucleic acid
mdcayytrytrarvtgggg

SEQ ID NO: 5549 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (8)..(8): base is a locked nucleic acid
  modified_base (9)..(9): base is a locked nucleic acid
  modified_base (11)..(11): base is a locked nucleic acid
mdcayytrytrarvtgggg

SEQ ID NO: 5550 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (2)..(2): base is a locked nucleic acid
  modified_base (9)..(9): base is a locked nucleic acid
  modified_base (11)..(11): base is a locked nucleic acid
mdcayytrytrarvtgggg

SEQ ID NO: 5551 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (3)..(3): base is a locked nucleic acid
  modified_base (9)..(9): base is a locked nucleic acid
  modified_base (11)..(11): base is a locked nucleic acid
mdcayytrytrarvtgggg

SEQ ID NO: 5552 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (4)..(4): base is a locked nucleic acid
  modified_base (9)..(9): base is a locked nucleic acid
  modified_base (11)..(11): base is a locked nucleic acid
mdcayytrytrarvtgggg

SEQ ID NO: 5553 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
  modified_base (9)..(9): base is a locked nucleic acid
  modified_base (11)..(11): base is a locked nucleic acid
mdcayytrytrarvtgggg

SEQ ID NO: 5554 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (12)..(12): base is a locked nucleic acid
dcayytrytrarvtggg

SEQ ID NO: 5555 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (16)..(16): base is a locked nucleic acid
dcayytrytrarvtggg

SEQ ID NO: 5556 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (15)..(15): base is a locked nucleic acid
dcayytrytrarvtggg

SEQ ID NO: 5557 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (14)..(14): base is a locked nucleic acid
dcayytrytrarvtggg

SEQ ID NO: 5558 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (7)..(7): base is a locked nucleic acid
dcayytrytrarvtggg

SEQ ID NO: 5559 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (2)..(2): base is a locked nucleic acid
dcayytrytrarvtggg

SEQ ID NO: 5560 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (8)..(8): base is a locked nucleic acid
dcayytrytrarvtggg

SEQ ID NO: 5561 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (4)..(4): base is a locked nucleic acid
dcayytrytrarvtggg

SEQ ID NO: 5562 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (17)..(17): base is a locked nucleic acid
dcayytrytrarvtggg

SEQ ID NO: 5563 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (13)..(13): base is a locked nucleic acid
dcayytrytrarvtggg

SEQ ID NO: 5564 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (15)..(15): base is a locked nucleic acid
dcayytrytrarvtggg

SEQ ID NO: 5565 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (12)..(12): base is a locked nucleic acid
dcayytrytrarvtggg

SEQ ID NO: 5566 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (7)..(7): base is a locked nucleic acid
  modified_base (8)..(8): base is a locked nucleic acid
  modified_base (10)..(10): base is a locked nucleic acid
dcayytrytrarvtggg

SEQ ID NO: 5567 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (1)..(1): base is a locked nucleic acid
  modified_base (8)..(8): base is a locked nucleic acid
  modified_base (10)..(10): base is a locked nucleic acid
dcayytrytrarvtggg

SEQ ID NO: 5568 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (2)..(2): base is a locked nucleic acid
  modified_base (8)..(8): base is a locked nucleic acid
  modified_base (10)..(10): base is a locked nucleic acid
dcayytrytrarvtggg

SEQ ID NO: 5569 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (3)..(3): base is a locked nucleic acid
  modified_base (8)..(8): base is a locked nucleic acid
  modified_base (10)..(10): base is a locked nucleic acid
dcayytrytrarvtggg

SEQ ID NO: 5570 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
dcayytrytrarvtggg

SEQ ID NO: 5571 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (12)..(12): base is a locked nucleic acid
dcayytrytrarvtg

SEQ ID NO: 5572 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
dcayytrytrarvtg

SEQ ID NO: 5573 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (15)..(15): base is a locked nucleic acid
dcayytrytrarvtg

SEQ ID NO: 5574 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (14)..(14): base is a locked nucleic acid
dcayytrytrarvtg

SEQ ID NO: 5575 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (7)..(7): base is a locked nucleic acid
dcayytrytrarvtg

SEQ ID NO: 5576 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (2)..(2): base is a locked nucleic acid
dcayytrytrarvtg

SEQ ID NO: 5577 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (8)..(8): base is a locked nucleic acid
dcayytrytrarvtg

SEQ ID NO: 5578 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (4)..(4): base is a locked nucleic acid
dcayytrytrarvtg

SEQ ID NO: 5579 - DNA, 16 bp, Artificial Sequence
  Oligonucleotide probe
  misc_binding (1)..(16): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
dcayytrytrarvtgg

SEQ ID NO: 5580 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (13)..(13): base is a locked nucleic acid
dcayytrytrarvtg

SEQ ID NO: 5581 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (15)..(15): base is a locked nucleic acid
dcayytrytrarvtg

SEQ ID NO: 5582 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (12)..(12): base is a locked nucleic acid
dcayytrytrarvtg

SEQ ID NO: 5583 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (7)..(7): base is a locked nucleic acid
  modified_base (8)..(8): base is a locked nucleic acid
  modified_base (10)..(10): base is a locked nucleic acid
dcayytrytrarvtg

SEQ ID NO: 5584 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (1)..(1): base is a locked nucleic acid
  modified_base (8)..(8): base is a locked nucleic acid
  modified_base (10)..(10): base is a locked nucleic acid
dcayytrytrarvtg

SEQ ID NO: 5585 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (2)..(2): base is a locked nucleic acid
  modified_base (8)..(8): base is a locked nucleic acid
  modified_base (10)..(10): base is a locked nucleic acid
dcayytrytrarvtg

SEQ ID NO: 5586 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (3)..(3): base is a locked nucleic acid
  modified_base (8)..(8): base is a locked nucleic acid
  modified_base (10)..(10): base is a locked nucleic acid
dcayytrytrarvtg

SEQ ID NO: 5587 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
dcayytrytrarvtg

SEQ ID NO: 5588 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (12)..(12): base is a locked nucleic acid
dcayytrytrarv

SEQ ID NO: 5589 - DNA, 14 bp, Artificial Sequence
  Oligonucleotide probe
  misc_binding (1)..(14): Hybridization probe for the specific detection of wild-type HIV-1 at codon 210 of the reverse transcriptase gene.
dcayytrytrarvt

SEQ ID NO: 5590 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
dcayytrytrarv

SEQ ID NO: 5591 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (7)..(7): base is a locked nucleic acid
dcayytrytrarv

SEQ ID NO: 5592 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (2)..(2): base is a locked nucleic acid
dcayytrytrarv

SEQ ID NO: 5593 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (8)..(8): base is a locked nucleic acid
dcayytrytrarv

SEQ ID NO: 5594 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (4)..(4): base is a locked nucleic acid
dcayytrytrarv

SEQ ID NO: 5595 - DNA, 14 bp, Artificial Sequence
  Oligonucleotide probe
  misc_binding (1)..(14): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
dcayytrytrarvt

SEQ ID NO: 5596 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (13)..(13): base is a locked nucleic acid
dcayytrytrarv

SEQ ID NO: 5597 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
  modified_base (12)..(12): base is a locked nucleic acid
dcayytrytrarv

SEQ ID NO: 5598 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (7)..(7): base is a locked nucleic acid
  modified_base (8)..(8): base is a locked nucleic acid
  modified_base (10)..(10): base is a locked nucleic acid
dcayytrytrarv

SEQ ID NO: 5599 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (1)..(1): base is a locked nucleic acid
  modified_base (8)..(8): base is a locked nucleic acid
  modified_base (10)..(10): base is a locked nucleic acid
dcayytrytrarv

SEQ ID NO: 5600 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (2)..(2): base is a locked nucleic acid
  modified_base (8)..(8): base is a locked nucleic acid
  modified_base (10)..(10): base is a locked nucleic acid
dcayytrytrarv

SEQ ID NO: 5601 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (3)..(3): base is a locked nucleic acid
  modified_base (8)..(8): base is a locked nucleic acid
  modified_base (10)..(10): base is a locked nucleic acid
dcayytrytrarv

SEQ ID NO: 5602 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
  modified_base (8)..(8): base is a locked nucleic acid
  modified_base (10)..(10): base is a locked nucleic acid
dcayytrytrarv

SEQ ID NO: 5603 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
catctgytraggtgg

SEQ ID NO: 5604 - DNA, 19 bp, Artificial Sequence
  Oligonucleotide probe
  misc_binding (1)..(19): Hybridization probe for the specific detection of wild-type HIV-1 at codon 210 of the reverse transcriptase gene.
mdcayytrytrarvtgggg

SEQ ID NO: 5605 - DNA, 17 bp, Artificial Sequence
  Oligonucleotide probe
  misc_binding (1)..(17): Hybridization probe for the specific detection of wild-type HIV-1 at codon 210 of the reverse transcriptase gene.
dcayytrytrarvtggg

SEQ ID NO: 5606 - DNA, 15 bp, Artificial Sequence
  Oligonucleotide probe
  misc_binding (1)..(15): Hybridization probe for the specific detection of wild-type HIV-1 at codon 210 of the reverse transcriptase gene.
dcayytrytrarvtg

SEQ ID NO: 5607 - DNA, 16 bp, Artificial Sequence
  Oligonucleotide probe
  misc_binding (1)..(16): Hybridization probe for the specific detection of wild-type HIV-1 at codon 210 of the reverse transcriptase gene.
dcayytrytrarvtgg

SEQ ID NO: 5608 - DNA, 13 bp, Artificial Sequence
  Oligonucleotide probe
  misc_binding (1)..(13): Hybridization probe for the specific detection of wild-type HIV-1 at codon 210 of the reverse transcriptase gene.
dcayytrytrarv

SEQ ID NO: 5609 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (12)..(12): base is a locked nucleic acid
ggggrytywcyacaccaga

SEQ ID NO: 5610 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (14)..(14): base is a locked nucleic acid
ggggrytywcyacaccaga

SEQ ID NO: 5611 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (11)..(11): base is a locked nucleic acid
ggggrytywcyacaccaga

SEQ ID NO: 5612 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (19)..(19): base is a locked nucleic acid
ggggrytywcyacaccaga

SEQ ID NO: 5613 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (8)..(8): base is a locked nucleic acid
ggggrytywcyacaccaga

SEQ ID NO: 5614 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (5)..(5): base is a locked nucleic acid
ggggrytywcyacaccaga

SEQ ID NO: 5615 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (2)..(2): base is a locked nucleic acid
ggggrytywcyacaccaga

SEQ ID NO: 5616 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (4)..(4): base is a locked nucleic acid
ggggrytywcyacaccaga

SEQ ID NO: 5617 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (9)..(9): base is a locked nucleic acid
  modified_base (11)..(11): base is a locked nucleic acid
  modified_base (13)..(13): base is a locked nucleic acid
ggggrytywcyacaccaga

SEQ ID NO: 5618 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (9)..(9): base is a locked nucleic acid
  modified_base (11)..(11): base is a locked nucleic acid
  modified_base (18)..(18): base is a locked nucleic acid
ggggrytywcyacaccaga

SEQ ID NO: 5619 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (9)..(9): base is a locked nucleic acid
  modified_base (11)..(11): base is a locked nucleic acid
  modified_base (12)..(12): base is a locked nucleic acid
ggggrytywcyacaccaga

SEQ ID NO: 5620 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (9)..(9): base is a locked nucleic acid
  modified_base (11)..(11): base is a locked nucleic acid
  modified_base (14)..(14): base is a locked nucleic acid
ggggrytywcyacaccaga

SEQ ID NO: 5621 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (4)..(4): base is a locked nucleic acid
  modified_base (9)..(9): base is a locked nucleic acid
  modified_base (11)..(11): base is a locked nucleic acid
ggggrytywcyacaccaga

SEQ ID NO: 5622 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (3)..(3): base is a locked nucleic acid
  modified_base (9)..(9): base is a locked nucleic acid
  modified_base (11)..(11): base is a locked nucleic acid
ggggrytywcyacaccaga

SEQ ID NO: 5623 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (6)..(6): base is a locked nucleic acid
  modified_base (9)..(9): base is a locked nucleic acid
  modified_base (11)..(11): base is a locked nucleic acid
ggggrytywcyacaccaga

SEQ ID NO: 5624 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (8)..(8): base is a locked nucleic acid
  modified_base (9)..(9): base is a locked nucleic acid
  modified_base (11)..(11): base is a locked nucleic acid
ggggrytywcyacaccaga

SEQ ID NO: 5625 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
  modified_base (9)..(9): base is a locked nucleic acid
  modified_base (11)..(11): base is a locked nucleic acid
ggggrytywcyacaccaga

SEQ ID NO: 5626 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (11)..(11): base is a locked nucleic acid
gggrytywcyacaccag

SEQ ID NO: 5627 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (13)..(13): base is a locked nucleic acid
gggrytywcyacaccag

SEQ ID NO: 5628 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (10)..(10): base is a locked nucleic acid
gggrytywcyacaccag

SEQ ID NO: 5629 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
gggrytywcyacaccag

SEQ ID NO: 5630 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (7)..(7): base is a locked nucleic acid
gggrytywcyacaccag

SEQ ID NO: 5631 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (4)..(4): base is a locked nucleic acid
gggrytywcyacaccag

SEQ ID NO: 5632 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (1)..(1): base is a locked nucleic acid
gggrytywcyacaccag

SEQ ID NO: 5633 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (3)..(3): base is a locked nucleic acid
gggrytywcyacaccag

SEQ ID NO: 5634 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (12)..(12): base is a locked nucleic acid
gggrytywcyacaccag

SEQ ID NO: 5635 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (17)..(17): base is a locked nucleic acid
gggrytywcyacaccag

SEQ ID NO: 5636 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (11)..(11): base is a locked nucleic acid
gggrytywcyacaccag

SEQ ID NO: 5637 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (13)..(13): base is a locked nucleic acid
gggrytywcyacaccag

SEQ ID NO: 5638 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (3)..(3): base is a locked nucleic acid
  modified_base (8)..(8): base is a locked nucleic acid
  modified_base (10)..(10): base is a locked nucleic acid
gggrytywcyacaccag

SEQ ID NO: 5639 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (2)..(2): base is a locked nucleic acid
  modified_base (8)..(8): base is a locked nucleic acid
  modified_base (10)..(10): base is a locked nucleic acid
gggrytywcyacaccag

SEQ ID NO: 5640 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (5)..(5): base is a locked nucleic acid
  modified_base (8)..(8): base is a locked nucleic acid
  modified_base (10)..(10): base is a locked nucleic acid
gggrytywcyacaccag

SEQ ID NO: 5641 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (7)..(7): base is a locked nucleic acid
  modified_base (8)..(8): base is a locked nucleic acid
  modified_base (10)..(10): base is a locked nucleic acid
gggrytywcyacaccag

SEQ ID NO: 5642 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
gggrytywcyacaccag

SEQ ID NO: 5643 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (11)..(11): base is a locked nucleic acid
gggrytywcyacacc

SEQ ID NO: 5644 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (13)..(13): base is a locked nucleic acid
gggrytywcyacacc

SEQ ID NO: 5645 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (10)..(10): base is a locked nucleic acid
gggrytywcyacacc

SEQ ID NO: 5646 - DNA, 16 bp, Artificial Sequence
  Oligonucleotide probe
  misc_binding (1)..(16): Hybridization probe for the specific detection of wild-type HIV-1 at codon 215 of the reverse transcriptase gene.
gggrytywcyacacca

SEQ ID NO: 5647 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (7)..(7): base is a locked nucleic acid
gggrytywcyacacc

SEQ ID NO: 5648 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (4)..(4): base is a locked nucleic acid
gggrytywcyacacc

SEQ ID NO: 5649 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (1)..(1): base is a locked nucleic acid
gggrytywcyacacc

SEQ ID NO: 5650 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (3)..(3): base is a locked nucleic acid
gggrytywcyacacc

SEQ ID NO: 5651 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (12)..(12): base is a locked nucleic acid
gggrytywcyacacc

SEQ ID NO: 5652 - DNA, 16 bp, Artificial Sequence
  Oligonucleotide probe
  misc_binding (1)..(16): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
gggrytywcyacacca

SEQ ID NO: 5653 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (11)..(11): base is a locked nucleic acid
gggrytywcyacacc

SEQ ID NO: 5654 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (13)..(13): base is a locked nucleic acid
gggrytywcyacacc

SEQ ID NO: 5655 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (3)..(3): base is a locked nucleic acid
  modified_base (8)..(8): base is a locked nucleic acid
  modified_base (10)..(10): base is a locked nucleic acid
gggrytywcyacacc

SEQ ID NO: 5656 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (2)..(2): base is a locked nucleic acid
  modified_base (8)..(8): base is a locked nucleic acid
  modified_base (10)..(10): base is a locked nucleic acid
gggrytywcyacacc

SEQ ID NO: 5657 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (5)..(5): base is a locked nucleic acid
  modified_base (8)..(8): base is a locked nucleic acid
  modified_base (10)..(10): base is a locked nucleic acid
gggrytywcyacacc

SEQ ID NO: 5658 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (7)..(7): base is a locked nucleic acid
  modified_base (8)..(8): base is a locked nucleic acid
  modified_base (10)..(10): base is a locked nucleic acid
gggrytywcyacacc

SEQ ID NO: 5659 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
gggrytywcyacacc

SEQ ID NO: 5660 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (11)..(11): base is a locked nucleic acid
gggrytywcyaca

SEQ ID NO: 5661 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (13)..(13): base is a locked nucleic acid
gggrytywcyaca

SEQ ID NO: 5662 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (10)..(10): base is a locked nucleic acid
gggrytywcyaca

SEQ ID NO: 5663 - DNA, 14 bp, Artificial Sequence
  Oligonucleotide probe
  misc_binding (1)..(14): Hybridization probe for the specific detection of wild-type HIV-1 at codon 215 of the reverse transcriptase gene.
gggrytywcyacac

SEQ ID NO: 5664 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (7)..(7): base is a locked nucleic acid
gggrytywcyaca

SEQ ID NO: 5665 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (4)..(4): base is a locked nucleic acid
gggrytywcyaca

SEQ ID NO: 5666 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (1)..(1): base is a locked nucleic acid
gggrytywcyaca

SEQ ID NO: 5667 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (3)..(3): base is a locked nucleic acid
gggrytywcyaca

SEQ ID NO: 5668 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (12)..(12): base is a locked nucleic acid
gggrytywcyaca

SEQ ID NO: 5669 - DNA, 14 bp, Artificial Sequence
  Oligonucleotide probe
  misc_binding (1)..(14): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
gggrytywcyacac

SEQ ID NO: 5670 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (11)..(11): base is a locked nucleic acid
gggrytywcyaca

SEQ ID NO: 5671 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
  modified_base (13)..(13): base is a locked nucleic acid
gggrytywcyaca

SEQ ID NO: 5672 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (3)..(3): base is a locked nucleic acid
  modified_base (8)..(8): base is a locked nucleic acid
  modified_base (10)..(10): base is a locked nucleic acid
gggrytywcyaca

SEQ ID NO: 5673 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (2)..(2): base is a locked nucleic acid
  modified_base (8)..(8): base is a locked nucleic acid
  modified_base (10)..(10): base is a locked nucleic acid
gggrytywcyaca

SEQ ID NO: 5674 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (5)..(5): base is a locked nucleic acid
  modified_base (8)..(8): base is a locked nucleic acid
  modified_base (10)..(10): base is a locked nucleic acid
gggrytywcyaca

SEQ ID NO: 5675 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (7)..(7): base is a locked nucleic acid
  modified_base (8)..(8): base is a locked nucleic acid
  modified_base (10)..(10): base is a locked nucleic acid
gggrytywcyaca

SEQ ID NO: 5676 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
  modified_base (8)..(8): base is a locked nucleic acid
  modified_base (10)..(10): base is a locked nucleic acid
gggrytywcyaca

SEQ ID NO: 5677 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
tggtgtrgtaaatcc

SEQ ID NO: 5678 - DNA, 19 bp, Artificial Sequence
  Oligonucleotide probe
  misc_binding (1)..(19): Hybridization probe for the specific detection of wild-type HIV-1 at codon 215 of the reverse transcriptase gene.
ggggrytywcyacaccaga

SEQ ID NO: 5679 - DNA, 17 bp, Artificial Sequence
  Oligonucleotide probe
  misc_binding (1)..(17): Hybridization probe for the specific detection of wild-type HIV-1 at codon 215 of the reverse transcriptase gene.
gggrytywcyacaccag

SEQ ID NO: 5680 - DNA, 15 bp, Artificial Sequence
  Oligonucleotide probe
  misc_binding (1)..(15): Hybridization probe for the specific detection of wild-type HIV-1 at codon 215 of the reverse transcriptase gene.
gggrytywcyacacc

SEQ ID NO: 5681 - DNA, 13 bp, Artificial Sequence
  Oligonucleotide probe
  misc_binding (1)..(13): Hybridization probe for the specific detection of wild-type HIV-1 at codon 215 of the reverse transcriptase gene.
gggrytywcyaca

SEQ ID NO: 5682 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (15)..(15): base is a locked nucleic acid
acaccagayaaraarcatc

SEQ ID NO: 5683 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (11)..(11): base is a locked nucleic acid
acaccagayaaraarcatc

SEQ ID NO: 5684 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (13)..(13): base is a locked nucleic acid
accagayaaraarcatcar

SEQ ID NO: 5685 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (18)..(18): base is a locked nucleic acid
acaccagayaaraarcatc

SEQ ID NO: 5686 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (13)..(13): base is a locked nucleic acid
caccagayaaraarcatca

SEQ ID NO: 5687 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (12)..(12): base is a locked nucleic acid
acaccagayaaraarcatc

SEQ ID NO: 5688 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (13)..(13): base is a locked nucleic acid
acaccagayaaraarcatc

SEQ ID NO: 5689 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (19)..(19): base is a locked nucleic acid
accagayaaraarcatcar

SEQ ID NO: 5690 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (17)..(17): base is a locked nucleic acid
caccagayaaraarcatca

SEQ ID NO: 5691 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (17)..(17): base is a locked nucleic acid
acaccagayaaraarcatc

SEQ ID NO: 5692 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (16)..(16): base is a locked nucleic acid
accagayaaraarcatcar

SEQ ID NO: 5693 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (19)..(19): base is a locked nucleic acid
acaccagayaaraarcatc

SEQ ID NO: 5694 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (16)..(16): base is a locked nucleic acid
caccagayaaraarcatca

SEQ ID NO: 5695 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (16)..(16): base is a locked nucleic acid
acaccagayaaraarcatc

SEQ ID NO: 5696 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (17)..(17): base is a locked nucleic acid
accagayaaraarcatcar

SEQ ID NO: 5697 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (15)..(15): base is a locked nucleic acid
caccagayaaraarcatca

SEQ ID NO: 5698 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
acaccagayaaraarcatc

SEQ ID NO: 5699 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (2)..(2): base is a locked nucleic acid
acaccagayaaraarcatc

SEQ ID NO: 5700 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
accagayaaraarcatcar

SEQ ID NO: 5701 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (8)..(8): base is a locked nucleic acid
caccagayaaraarcatca

SEQ ID NO: 5702 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (6)..(6): base is a locked nucleic acid
acaccagayaaraarcatc

SEQ ID NO: 5703 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (7)..(7): base is a locked nucleic acid
accagayaaraarcatcar

SEQ ID NO: 5704 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (3)..(3): base is a locked nucleic acid
acaccagayaaraarcatc

SEQ ID NO: 5705 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (3)..(3): base is a locked nucleic acid
caccagayaaraarcatca

SEQ ID NO: 5706 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (4)..(4): base is a locked nucleic acid
acaccagayaaraarcatc

SEQ ID NO: 5707 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (4)..(4): base is a locked nucleic acid
accagayaaraarcatcar

SEQ ID NO: 5708 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
caccagayaaraarcatca

SEQ ID NO: 5709 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (5)..(5): base is a locked nucleic acid
acaccagayaaraarcatc

SEQ ID NO: 5710 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (7)..(7): base is a locked nucleic acid
acaccagayaaraarcatc

SEQ ID NO: 5711 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (6)..(6): base is a locked nucleic acid
accagayaaraarcatcar

SEQ ID NO: 5712 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (8)..(8): base is a locked nucleic acid
acaccagayaaraarcatc

SEQ ID NO: 5713 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (5)..(5): base is a locked nucleic acid
caccagayaaraarcatca

SEQ ID NO: 5714 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (12)..(12): base is a locked nucleic acid
acaccagayaaraarcatc

SEQ ID NO: 5715 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (16)..(16): base is a locked nucleic acid
acaccagayaaraarcatc

SEQ ID NO: 5716 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (14)..(14): base is a locked nucleic acid
accagayaaraarcatcar

SEQ ID NO: 5717 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (18)..(18): base is a locked nucleic acid
caccagayaaraarcatca

SEQ ID NO: 5718 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (19)..(19): base is a locked nucleic acid
acaccagayaaraarcatc

SEQ ID NO: 5719 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (15)..(15): base is a locked nucleic acid
acaccagayaaraarcatc

SEQ ID NO: 5720 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (16)..(16): base is a locked nucleic acid
accagayaaraarcatcar

SEQ ID NO: 5721 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (14)..(14): base is a locked nucleic acid
caccagayaaraarcatca

SEQ ID NO: 5722 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (14)..(14): base is a locked nucleic acid
acaccagayaaraarcatc

SEQ ID NO: 5723 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (19)..(19): base is a locked nucleic acid
accagayaaraarcatcar

SEQ ID NO: 5724 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (16)..(16): base is a locked nucleic acid
caccagayaaraarcatca

SEQ ID NO: 5725 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (18)..(18): base is a locked nucleic acid
acaccagayaaraarcatc

SEQ ID NO: 5726 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (15)..(15): base is a locked nucleic acid
accagayaaraarcatcar

SEQ ID NO: 5727 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
  modified_base (13)..(13): base is a locked nucleic acid
caccagayaaraarcatca

SEQ ID NO: 5728 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (6)..(6): base is a locked nucleic acid
  modified_base (9)..(9): base is a locked nucleic acid
  modified_base (11)..(11): base is a locked nucleic acid
acaccagayaaraarcatc

SEQ ID NO: 5729 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (2)..(2): base is a locked nucleic acid
  modified_base (9)..(9): base is a locked nucleic acid
  modified_base (11)..(11): base is a locked nucleic acid
acaccagayaaraarcatc

SEQ ID NO: 5730 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (2)..(2): base is a locked nucleic acid
  modified_base (9)..(9): base is a locked nucleic acid
  modified_base (11)..(11): base is a locked nucleic acid
accagayaaraarcatcar

SEQ ID NO: 5731 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (5)..(5): base is a locked nucleic acid
  modified_base (9)..(9): base is a locked nucleic acid
  modified_base (11)..(11): base is a locked nucleic acid
acaccagayaaraarcatc

SEQ ID NO: 5732 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (8)..(8): base is a locked nucleic acid
  modified_base (9)..(9): base is a locked nucleic acid
  modified_base (11)..(11): base is a locked nucleic acid
caccagayaaraarcatca

SEQ ID NO: 5733 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (8)..(8): base is a locked nucleic acid
  modified_base (9)..(9): base is a locked nucleic acid
  modified_base (11)..(11): base is a locked nucleic acid
accagayaaraarcatcar

SEQ ID NO: 5734 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (4)..(4): base is a locked nucleic acid
  modified_base (9)..(9): base is a locked nucleic acid
  modified_base (11)..(11): base is a locked nucleic acid
acaccagayaaraarcatc

SEQ ID NO: 5735 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (2)..(2): base is a locked nucleic acid
  modified_base (9)..(9): base is a locked nucleic acid
  modified_base (11)..(11): base is a locked nucleic acid
caccagayaaraarcatca

SEQ ID NO: 5736 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (7)..(7): base is a locked nucleic acid
  modified_base (9)..(9): base is a locked nucleic acid
  modified_base (11)..(11): base is a locked nucleic acid
acaccagayaaraarcatc

SEQ ID NO: 5737 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (3)..(3): base is a locked nucleic acid
  modified_base (9)..(9): base is a locked nucleic acid
  modified_base (11)..(11): base is a locked nucleic acid
acaccagayaaraarcatc

SEQ ID NO: 5738 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (4)..(4): base is a locked nucleic acid
  modified_base (9)..(9): base is a locked nucleic acid
  modified_base (11)..(11): base is a locked nucleic acid
accagayaaraarcatcar

SEQ ID NO: 5739 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (3)..(3): base is a locked nucleic acid
  modified_base (9)..(9): base is a locked nucleic acid
  modified_base (11)..(11): base is a locked nucleic acid
caccagayaaraarcatca

SEQ ID NO: 5740 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (5)..(5): base is a locked nucleic acid
  modified_base (9)..(9): base is a locked nucleic acid
  modified_base (11)..(11): base is a locked nucleic acid
accagayaaraarcatcar

SEQ ID NO: 5741 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (4)..(4): base is a locked nucleic acid
  modified_base (9)..(9): base is a locked nucleic acid
  modified_base (11)..(11): base is a locked nucleic acid
caccagayaaraarcatca

SEQ ID NO: 5742 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
acaccagayaaraarcatc

SEQ ID NO: 5743 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
accagayaaraarcatcar

SEQ ID NO: 5744 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
  modified_base (9)..(9): base is a locked nucleic acid
  modified_base (11)..(11): base is a locked nucleic acid
caccagayaaraarcatca

SEQ ID NO: 5745 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (14)..(14): base is a locked nucleic acid
caccagayaaraarcat

SEQ ID NO: 5746 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (10)..(10): base is a locked nucleic acid
caccagayaaraarcat

SEQ ID NO: 5747 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (12)..(12): base is a locked nucleic acid
ccagayaaraarcatca

SEQ ID NO: 5748 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (17)..(17): base is a locked nucleic acid
caccagayaaraarcat

SEQ ID NO: 5749 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (12)..(12): base is a locked nucleic acid
accagayaaraarcatc

SEQ ID NO: 5750 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (11)..(11): base is a locked nucleic acid
caccagayaaraarcat

SEQ ID NO: 5751 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (12)..(12): base is a locked nucleic acid
caccagayaaraarcat

SEQ ID NO: 5752 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
ccagayaaraarcatca

SEQ ID NO: 5753 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (16)..(16): base is a locked nucleic acid
accagayaaraarcatc

SEQ ID NO: 5754 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (16)..(16): base is a locked nucleic acid
caccagayaaraarcat

SEQ ID NO: 5755 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (15)..(15): base is a locked nucleic acid
ccagayaaraarcatca

SEQ ID NO: 5756 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
caccagayaaraarcat

SEQ ID NO: 5757 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (15)..(15): base is a locked nucleic acid
accagayaaraarcatc

SEQ ID NO: 5758 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (15)..(15): base is a locked nucleic acid
caccagayaaraarcat

SEQ ID NO: 5759 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (16)..(16): base is a locked nucleic acid
ccagayaaraarcatca

SEQ ID NO: 5760 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (14)..(14): base is a locked nucleic acid
accagayaaraarcatc

SEQ ID NO: 5761 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
caccagayaaraarcat

SEQ ID NO: 5762 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (1)..(1): base is a locked nucleic acid
caccagayaaraarcat

SEQ ID NO: 5763 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
ccagayaaraarcatca

SEQ ID NO: 5764 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (7)..(7): base is a locked nucleic acid
accagayaaraarcatc

SEQ ID NO: 5765 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (5)..(5): base is a locked nucleic acid
caccagayaaraarcat

SEQ ID NO: 5766 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (6)..(6): base is a locked nucleic acid
ccagayaaraarcatca

SEQ ID NO: 5767 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (2)..(2): base is a locked nucleic acid
caccagayaaraarcat

SEQ ID NO: 5768 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (2)..(2): base is a locked nucleic acid
accagayaaraarcatc

SEQ ID NO: 5769 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (3)..(3): base is a locked nucleic acid
caccagayaaraarcat

SEQ ID NO: 5770 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (3)..(3): base is a locked nucleic acid
ccagayaaraarcatca

SEQ ID NO: 5771 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
accagayaaraarcatc

SEQ ID NO: 5772 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (4)..(4): base is a locked nucleic acid
caccagayaaraarcat

SEQ ID NO: 5773 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (6)..(6): base is a locked nucleic acid
caccagayaaraarcat

SEQ ID NO: 5774 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (5)..(5): base is a locked nucleic acid
ccagayaaraarcatca

SEQ ID NO: 5775 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (7)..(7): base is a locked nucleic acid
caccagayaaraarcat

SEQ ID NO: 5776 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (4)..(4): base is a locked nucleic acid
accagayaaraarcatc

SEQ ID NO: 5777 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (11)..(11): base is a locked nucleic acid
caccagayaaraarcat

SEQ ID NO: 5778 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (15)..(15): base is a locked nucleic acid
caccagayaaraarcat

SEQ ID NO: 5779 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
ccagayaaraarcatca

SEQ ID NO: 5780 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (17)..(17): base is a locked nucleic acid
accagayaaraarcatc

SEQ ID NO: 5781 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
caccagayaaraarcat

SEQ ID NO: 5782 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (14)..(14): base is a locked nucleic acid
caccagayaaraarcat

SEQ ID NO: 5783 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (15)..(15): base is a locked nucleic acid
ccagayaaraarcatca

SEQ ID NO: 5784 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
accagayaaraarcatc

SEQ ID NO: 5785 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
caccagayaaraarcat

SEQ ID NO: 5786 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
ccagayaaraarcatca

SEQ ID NO: 5787 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (15)..(15): base is a locked nucleic acid
accagayaaraarcatc

SEQ ID NO: 5788 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (17)..(17): base is a locked nucleic acid
caccagayaaraarcat

SEQ ID NO: 5789 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (14)..(14): base is a locked nucleic acid
ccagayaaraarcatca

SEQ ID NO: 5790 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (12)..(12): base is a locked nucleic acid
accagayaaraarcatc

SEQ ID NO: 5791 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (5)..(5): base is a locked nucleic acid
  modified_base (8)..(8): base is a locked nucleic acid
  modified_base (10)..(10): base is a locked nucleic acid
caccagayaaraarcat

SEQ ID NO: 5792 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
caccagayaaraarcat

SEQ ID NO: 5793 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
ccagayaaraarcatca

SEQ ID NO: 5794 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (4)..(4): base is a locked nucleic acid
  modified_base (8)..(8): base is a locked nucleic acid
  modified_base (10)..(10): base is a locked nucleic acid
caccagayaaraarcat

SEQ ID NO: 5795 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (7)..(7): base is a locked nucleic acid
  modified_base (8)..(8): base is a locked nucleic acid
  modified_base (10)..(10): base is a locked nucleic acid
accagayaaraarcatc

SEQ ID NO: 5796 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (7)..(7): base is a locked nucleic acid
  modified_base (8)..(8): base is a locked nucleic acid
  modified_base (10)..(10): base is a locked nucleic acid
ccagayaaraarcatca

SEQ ID NO: 5797 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
caccagayaaraarcat

SEQ ID NO: 5798 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
accagayaaraarcatc

SEQ ID NO: 5799 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (6)..(6): base is a locked nucleic acid
  modified_base (8)..(8): base is a locked nucleic acid
  modified_base (10)..(10): base is a locked nucleic acid
caccagayaaraarcat

SEQ ID NO: 5800 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (2)..(2): base is a locked nucleic acid
  modified_base (8)..(8): base is a locked nucleic acid
  modified_base (10)..(10): base is a locked nucleic acid
caccagayaaraarcat

SEQ ID NO: 5801 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
ccagayaaraarcatca

SEQ ID NO: 5802 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (2)..(2): base is a locked nucleic acid
  modified_base (8)..(8): base is a locked nucleic acid
  modified_base (10)..(10): base is a locked nucleic acid
accagayaaraarcatc

SEQ ID NO: 5803 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (4)..(4): base is a locked nucleic acid
  modified_base (8)..(8): base is a locked nucleic acid
  modified_base (10)..(10): base is a locked nucleic acid
ccagayaaraarcatca

SEQ ID NO: 5804 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
accagayaaraarcatc

SEQ ID NO: 5805 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
caccagayaaraarcat

SEQ ID NO: 5806 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
ccagayaaraarcatca

SEQ ID NO: 5807 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
accagayaaraarcatc

SEQ ID NO: 5808 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (14)..(14): base is a locked nucleic acid
caccagayaaraarc

SEQ ID NO: 5809 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (10)..(10): base is a locked nucleic acid
caccagayaaraarc

SEQ ID NO: 5810 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (12)..(12): base is a locked nucleic acid
ccagayaaraarcat

SEQ ID NO: 5811 - DNA, 16 bp, Artificial Sequence
  Oligonucleotide probe
  misc_binding (1)..(16): Hybridization probe for the specific detection of wild-type HIV-1 at codon 219 of the reverse transcriptase gene.
caccagayaaraarca

SEQ ID NO: 5812 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (12)..(12): base is a locked nucleic acid
accagayaaraarca

SEQ ID NO: 5813 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (11)..(11): base is a locked nucleic acid
caccagayaaraarc

SEQ ID NO: 5814 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (12)..(12): base is a locked nucleic acid
caccagayaaraarc

SEQ ID NO: 5815 - DNA, 16 bp, Artificial Sequence
  Oligonucleotide probe
  misc_binding (1)..(16): Hybridization probe for the specific detection of wild-type HIV-1 at codon 219 of the reverse transcriptase gene.
ccagayaaraarcatc

SEQ ID NO: 5816 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
accagayaaraarca

SEQ ID NO: 5817 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
caccagayaaraarc

SEQ ID NO: 5818 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (15)..(15): base is a locked nucleic acid
ccagayaaraarcat

SEQ ID NO: 5819 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (15)..(15): base is a locked nucleic acid
accagayaaraarca

SEQ ID NO: 5820 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (15)..(15): base is a locked nucleic acid
caccagayaaraarc

SEQ ID NO: 5821 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
ccagayaaraarcat

SEQ ID NO: 5822 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (14)..(14): base is a locked nucleic acid
accagayaaraarca

SEQ ID NO: 5823 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
caccagayaaraarc

SEQ ID NO: 5824 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (1)..(1): base is a locked nucleic acid
caccagayaaraarc

SEQ ID NO: 5825 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
ccagayaaraarcat

SEQ ID NO: 5826 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (7)..(7): base is a locked nucleic acid
accagayaaraarca

SEQ ID NO: 5827 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (5)..(5): base is a locked nucleic acid
caccagayaaraarc

SEQ ID NO: 5828 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (6)..(6): base is a locked nucleic acid
ccagayaaraarcat

SEQ ID NO: 5829 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (2)..(2): base is a locked nucleic acid
caccagayaaraarc

SEQ ID NO: 5830 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (2)..(2): base is a locked nucleic acid
accagayaaraarca

SEQ ID NO: 5831 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (3)..(3): base is a locked nucleic acid
caccagayaaraarc

SEQ ID NO: 5832 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (3)..(3): base is a locked nucleic acid
ccagayaaraarcat

SEQ ID NO: 5833 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
accagayaaraarca

SEQ ID NO: 5834 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (4)..(4): base is a locked nucleic acid
caccagayaaraarc

SEQ ID NO: 5835 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (6)..(6): base is a locked nucleic acid
caccagayaaraarc

SEQ ID NO: 5836 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (5)..(5): base is a locked nucleic acid
ccagayaaraarcat

SEQ ID NO: 5837 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (7)..(7): base is a locked nucleic acid
caccagayaaraarc

SEQ ID NO: 5838 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (4)..(4): base is a locked nucleic acid
accagayaaraarca

SEQ ID NO: 5839 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (11)..(11): base is a locked nucleic acid
caccagayaaraarc

SEQ ID NO: 5840 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (15)..(15): base is a locked nucleic acid
caccagayaaraarc

SEQ ID NO: 5841 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
ccagayaaraarcat

SEQ ID NO: 5842 - DNA, 16 bp, Artificial Sequence
  Oligonucleotide probe
  misc_binding (1)..(16): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
accagayaaraarcat

SEQ ID NO: 5843 - DNA, 16 bp, Artificial Sequence
  Oligonucleotide probe
  misc_binding (1)..(16): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
caccagayaaraarca

SEQ ID NO: 5844 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (14)..(14): base is a locked nucleic acid
caccagayaaraarc

SEQ ID NO: 5845 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (15)..(15): base is a locked nucleic acid
ccagayaaraarcat

SEQ ID NO: 5846 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
accagayaaraarca

SEQ ID NO: 5847 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
caccagayaaraarc

SEQ ID NO: 5848 - DNA, 16 bp, Artificial Sequence
  Oligonucleotide probe
  misc_binding (1)..(16): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
ccagayaaraarcatc

SEQ ID NO: 5849 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (15)..(15): base is a locked nucleic acid
accagayaaraarca

SEQ ID NO: 5850 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (14)..(14): base is a locked nucleic acid
ccagayaaraarcat

SEQ ID NO: 5851 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (12)..(12): base is a locked nucleic acid
accagayaaraarca

SEQ ID NO: 5852 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (5)..(5): base is a locked nucleic acid
  modified_base (8)..(8): base is a locked nucleic acid
  modified_base (10)..(10): base is a locked nucleic acid
caccagayaaraarc

SEQ ID NO: 5853 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
caccagayaaraarc

SEQ ID NO: 5854 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
ccagayaaraarcat

SEQ ID NO: 5855 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (4)..(4): base is a locked nucleic acid
  modified_base (8)..(8): base is a locked nucleic acid
  modified_base (10)..(10): base is a locked nucleic acid
caccagayaaraarc

SEQ ID NO: 5856 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (7)..(7): base is a locked nucleic acid
  modified_base (8)..(8): base is a locked nucleic acid
  modified_base (10)..(10): base is a locked nucleic acid
accagayaaraarca

SEQ ID NO: 5857 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (7)..(7): base is a locked nucleic acid
  modified_base (8)..(8): base is a locked nucleic acid
  modified_base (10)..(10): base is a locked nucleic acid
ccagayaaraarcat

SEQ ID NO: 5858 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
caccagayaaraarc

SEQ ID NO: 5859 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
accagayaaraarca

SEQ ID NO: 5860 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (6)..(6): base is a locked nucleic acid
  modified_base (8)..(8): base is a locked nucleic acid
  modified_base (10)..(10): base is a locked nucleic acid
caccagayaaraarc

SEQ ID NO: 5861 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (2)..(2): base is a locked nucleic acid
  modified_base (8)..(8): base is a locked nucleic acid
  modified_base (10)..(10): base is a locked nucleic acid
caccagayaaraarc

SEQ ID NO: 5862 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
ccagayaaraarcat

SEQ ID NO: 5863 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (2)..(2): base is a locked nucleic acid
  modified_base (8)..(8): base is a locked nucleic acid
  modified_base (10)..(10): base is a locked nucleic acid
accagayaaraarca

SEQ ID NO: 5864 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (4)..(4): base is a locked nucleic acid
  modified_base (8)..(8): base is a locked nucleic acid
  modified_base (10)..(10): base is a locked nucleic acid
ccagayaaraarcat

SEQ ID NO: 5865 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
accagayaaraarca

SEQ ID NO: 5866 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
caccagayaaraarc

SEQ ID NO: 5867 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
ccagayaaraarcat

SEQ ID NO: 5868 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
accagayaaraarca

SEQ ID NO: 5869 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
caccagayaaraa

SEQ ID NO: 5870 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (10)..(10): base is a locked nucleic acid
caccagayaaraa

SEQ ID NO: 5871 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (12)..(12): base is a locked nucleic acid
ccagayaaraarc

SEQ ID NO: 5872 - DNA, 14 bp, Artificial Sequence
  Oligonucleotide probe
  misc_binding (1)..(14): Hybridization probe for the specific detection of wild-type HIV-1 at codon 219 of the reverse transcriptase gene.
caccagayaaraar

SEQ ID NO: 5873 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (12)..(12): base is a locked nucleic acid
accagayaaraar

SEQ ID NO: 5874 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (11)..(11): base is a locked nucleic acid
caccagayaaraa

SEQ ID NO: 5875 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (12)..(12): base is a locked nucleic acid
caccagayaaraa

SEQ ID NO: 5876 - DNA, 14 bp, Artificial Sequence
  Oligonucleotide probe
  misc_binding (1)..(14): Hybridization probe for the specific detection of wild-type HIV-1 at codon 219 of the reverse transcriptase gene.
ccagayaaraarca

SEQ ID NO: 5877 - DNA, 14 bp, Artificial Sequence
  Oligonucleotide probe
  misc_binding (1)..(14): Hybridization probe for the specific detection of wild-type HIV-1 at codon 219 of the reverse transcriptase gene.
accagayaaraarc

SEQ ID NO: 5878 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
accagayaaraar

SEQ ID NO: 5879 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
caccagayaaraa

SEQ ID NO: 5880 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (1)..(1): base is a locked nucleic acid
caccagayaaraa

SEQ ID NO: 5881 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
ccagayaaraarc

SEQ ID NO: 5882 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (7)..(7): base is a locked nucleic acid
accagayaaraar

SEQ ID NO: 5883 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (5)..(5): base is a locked nucleic acid
caccagayaaraa

SEQ ID NO: 5884 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (6)..(6): base is a locked nucleic acid
ccagayaaraarc

SEQ ID NO: 5885 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (2)..(2): base is a locked nucleic acid
caccagayaaraa

SEQ ID NO: 5886 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (2)..(2): base is a locked nucleic acid
accagayaaraar

SEQ ID NO: 5887 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (3)..(3): base is a locked nucleic acid
caccagayaaraa

SEQ ID NO: 5888 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (3)..(3): base is a locked nucleic acid
ccagayaaraarc

SEQ ID NO: 5889 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
accagayaaraar

SEQ ID NO: 5890 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (4)..(4): base is a locked nucleic acid
caccagayaaraa

SEQ ID NO: 5891 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (6)..(6): base is a locked nucleic acid
caccagayaaraa

SEQ ID NO: 5892 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (5)..(5): base is a locked nucleic acid
ccagayaaraarc

SEQ ID NO: 5893 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (7)..(7): base is a locked nucleic acid
caccagayaaraa

SEQ ID NO: 5894 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (4)..(4): base is a locked nucleic acid
accagayaaraar

SEQ ID NO: 5895 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (11)..(11): base is a locked nucleic acid
caccagayaaraa

SEQ ID NO: 5896 - DNA, 14 bp, Artificial Sequence
  Oligonucleotide probe
  misc_binding (1)..(14): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
caccagayaaraar

SEQ ID NO: 5897 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
ccagayaaraarc

SEQ ID NO: 5898 - DNA, 14 bp, Artificial Sequence
  Oligonucleotide probe
  misc_binding (1)..(14): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
accagayaaraarc

SEQ ID NO: 5899 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
caccagayaaraa

SEQ ID NO: 5900 - DNA, 14 bp, Artificial Sequence
  Oligonucleotide probe
  misc_binding (1)..(14): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
ccagayaaraarca

SEQ ID NO: 5901 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
accagayaaraar

SEQ ID NO: 5902 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (13)..(13): base is a locked nucleic acid
caccagayaaraa

SEQ ID NO: 5903 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
ccagayaaraarc

SEQ ID NO: 5904 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
  modified_base (12)..(12): base is a locked nucleic acid
accagayaaraar

SEQ ID NO: 5905 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (5)..(5): base is a locked nucleic acid
  modified_base (8)..(8): base is a locked nucleic acid
  modified_base (10)..(10): base is a locked nucleic acid
caccagayaaraa

SEQ ID NO: 5906 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
caccagayaaraa

SEQ ID NO: 5907 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
ccagayaaraarc

SEQ ID NO: 5908 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (4)..(4): base is a locked nucleic acid
  modified_base (8)..(8): base is a locked nucleic acid
  modified_base (10)..(10): base is a locked nucleic acid
caccagayaaraa

SEQ ID NO: 5909 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (7)..(7): base is a locked nucleic acid
  modified_base (8)..(8): base is a locked nucleic acid
  modified_base (10)..(10): base is a locked nucleic acid
accagayaaraar

SEQ ID NO: 5910 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (7)..(7): base is a locked nucleic acid
  modified_base (8)..(8): base is a locked nucleic acid
  modified_base (10)..(10): base is a locked nucleic acid
ccagayaaraarc

SEQ ID NO: 5911 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
caccagayaaraa

SEQ ID NO: 5912 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (1)..(1): base is a locked nucleic acid
  modified_base (8)..(8): base is a locked nucleic acid
  modified_base (10)..(10): base is a locked nucleic acid
accagayaaraar

SEQ ID NO: 5913 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (6)..(6): base is a locked nucleic acid
  modified_base (8)..(8): base is a locked nucleic acid
  modified_base (10)..(10): base is a locked nucleic acid
caccagayaaraa

SEQ ID NO: 5914 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (2)..(2): base is a locked nucleic acid
  modified_base (8)..(8): base is a locked nucleic acid
  modified_base (10)..(10): base is a locked nucleic acid
caccagayaaraa

SEQ ID NO: 5915 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
ccagayaaraarc

SEQ ID NO: 5916 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (2)..(2): base is a locked nucleic acid
  modified_base (8)..(8): base is a locked nucleic acid
  modified_base (10)..(10): base is a locked nucleic acid
accagayaaraar

SEQ ID NO: 5917 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (4)..(4): base is a locked nucleic acid
  modified_base (8)..(8): base is a locked nucleic acid
  modified_base (10)..(10): base is a locked nucleic acid
ccagayaaraarc

SEQ ID NO: 5918 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (3)..(3): base is a locked nucleic acid
  modified_base (8)..(8): base is a locked nucleic acid
  modified_base (10)..(10): base is a locked nucleic acid
accagayaaraar

SEQ ID NO: 5919 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
caccagayaaraa

SEQ ID NO: 5920 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
ccagayaaraarc

SEQ ID NO: 5921 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
  modified_base (8)..(8): base is a locked nucleic acid
  modified_base (10)..(10): base is a locked nucleic acid
accagayaaraar

SEQ ID NO: 5922 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
ccagacaaraaacat

SEQ ID NO: 5923 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
acaccagayaaraarcatc

SEQ ID NO: 5924 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
accagayaaraarcatcar

SEQ ID NO: 5925 - DNA, 19 bp, Artificial Sequence
  Oligonucleotide probe
  misc_binding (1)..(19): Hybridization probe for the specific detection of wild-type HIV-1 at codon 219 of the reverse transcriptase gene.
caccagayaaraarcatca

SEQ ID NO: 5926 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
caccagayaaraarcat

SEQ ID NO: 5927 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
ccagayaaraarcatca

SEQ ID NO: 5928 - DNA, 17 bp, Artificial Sequence
  Oligonucleotide probe
  misc_binding (1)..(17): Hybridization probe for the specific detection of wild-type HIV-1 at codon 219 of the reverse transcriptase gene.
accagayaaraarcatc

SEQ ID NO: 5929 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
caccagayaaraarc

SEQ ID NO: 5930 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
ccagayaaraarcat

SEQ ID NO: 5931 - DNA, 15 bp, Artificial Sequence
  Oligonucleotide probe
  misc_binding (1)..(15): Hybridization probe for the specific detection of wild-type HIV-1 at codon 219 of the reverse transcriptase gene.
accagayaaraarca

SEQ ID NO: 5932 - DNA, 16 bp, Artificial Sequence
  Oligonucleotide probe
  misc_binding (1)..(16): Hybridization probe for the specific detection of wild-type HIV-1 at codon 219 of the reverse transcriptase gene.
accagayaaraarcat

SEQ ID NO: 5933 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
caccagayaaraa

SEQ ID NO: 5934 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
ccagayaaraarc

SEQ ID NO: 5935 - DNA, 13 bp, Artificial Sequence
  Oligonucleotide probe
  misc_binding (1)..(13): Hybridization probe for the specific detection of wild-type HIV-1 at codon 219 of the reverse transcriptase gene.
accagayaaraar

SEQ ID NO: 5936 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (18)..(18): base is a locked nucleic acid
araargaaccyccattyct

SEQ ID NO: 5937 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (13)..(13): base is a locked nucleic acid
araargaaccyccattyct

SEQ ID NO: 5938 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (12)..(12): base is a locked nucleic acid
araargaaccyccattyct

SEQ ID NO: 5939 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (11)..(11): base is a locked nucleic acid
araargaaccyccattyct

SEQ ID NO: 5940 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (2)..(2): base is a locked nucleic acid
araargaaccyccattyct

SEQ ID NO: 5941 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (3)..(3): base is a locked nucleic acid
araargaaccyccattyct

SEQ ID NO: 5942 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (7)..(7): base is a locked nucleic acid
araargaaccyccattyct

SEQ ID NO: 5943 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (9)..(9): base is a locked nucleic acid
araargaaccyccattyct

SEQ ID NO: 5944 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (9)..(9): base is a locked nucleic acid
  modified_base (11)..(11): base is a locked nucleic acid
  modified_base (16)..(16): base is a locked nucleic acid
araargaaccyccattyct

SEQ ID NO: 5945 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (9)..(9): base is a locked nucleic acid
  modified_base (11)..(11): base is a locked nucleic acid
  modified_base (12)..(12): base is a locked nucleic acid
araargaaccyccattyct

SEQ ID NO: 5946 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (9)..(9): base is a locked nucleic acid
  modified_base (11)..(11): base is a locked nucleic acid
  modified_base (19)..(19): base is a locked nucleic acid
araargaaccyccattyct

SEQ ID NO: 5947 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (9)..(9): base is a locked nucleic acid
  modified_base (11)..(11): base is a locked nucleic acid
  modified_base (13)..(13): base is a locked nucleic acid
araargaaccyccattyct

SEQ ID NO: 5948 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (6)..(6): base is a locked nucleic acid
  modified_base (9)..(9): base is a locked nucleic acid
  modified_base (11)..(11): base is a locked nucleic acid
araargaaccyccattyct

SEQ ID NO: 5949 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (4)..(4): base is a locked nucleic acid
  modified_base (9)..(9): base is a locked nucleic acid
  modified_base (11)..(11): base is a locked nucleic acid
araargaaccyccattyct

SEQ ID NO: 5950 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (7)..(7): base is a locked nucleic acid
  modified_base (9)..(9): base is a locked nucleic acid
  modified_base (11)..(11): base is a locked nucleic acid
araargaaccyccattyct

SEQ ID NO: 5951 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (8)..(8): base is a locked nucleic acid
  modified_base (9)..(9): base is a locked nucleic acid
  modified_base (11)..(11): base is a locked nucleic acid
araargaaccyccattyct

SEQ ID NO: 5952 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
  modified_base (9)..(9): base is a locked nucleic acid
  modified_base (11)..(11): base is a locked nucleic acid
araargaaccyccattyct

SEQ ID NO: 5953 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (17)..(17): base is a locked nucleic acid
raargaaccyccattyc

SEQ ID NO: 5954 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (12)..(12): base is a locked nucleic acid
raargaaccyccattyc

SEQ ID NO: 5955 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (11)..(11): base is a locked nucleic acid
raargaaccyccattyc

SEQ ID NO: 5956 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (10)..(10): base is a locked nucleic acid
raargaaccyccattyc

SEQ ID NO: 5957 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (1)..(1): base is a locked nucleic acid
raargaaccyccattyc

SEQ ID NO: 5958 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (2)..(2): base is a locked nucleic acid
raargaaccyccattyc

SEQ ID NO: 5959 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (6)..(6): base is a locked nucleic acid
raargaaccyccattyc

SEQ ID NO: 5960 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (8)..(8): base is a locked nucleic acid
raargaaccyccattyc

SEQ ID NO: 5961 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (15)..(15): base is a locked nucleic acid
raargaaccyccattyc

SEQ ID NO: 5962 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (11)..(11): base is a locked nucleic acid
raargaaccyccattyc

SEQ ID NO: 5963 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
raargaaccyccattyc

SEQ ID NO: 5964 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (12)..(12): base is a locked nucleic acid
raargaaccyccattyc

SEQ ID NO: 5965 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (5)..(5): base is a locked nucleic acid
  modified_base (8)..(8): base is a locked nucleic acid
  modified_base (10)..(10): base is a locked nucleic acid
raargaaccyccattyc

SEQ ID NO: 5966 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (3)..(3): base is a locked nucleic acid
  modified_base (8)..(8): base is a locked nucleic acid
  modified_base (10)..(10): base is a locked nucleic acid
raargaaccyccattyc

SEQ ID NO: 5967 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (6)..(6): base is a locked nucleic acid
  modified_base (8)..(8): base is a locked nucleic acid
  modified_base (10)..(10): base is a locked nucleic acid
raargaaccyccattyc

SEQ ID NO: 5968 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (7)..(7): base is a locked nucleic acid
  modified_base (8)..(8): base is a locked nucleic acid
  modified_base (10)..(10): base is a locked nucleic acid
raargaaccyccattyc

SEQ ID NO: 5969 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
raargaaccyccattyc

SEQ ID NO: 5970 - DNA, 16 bp, Artificial Sequence
  Oligonucleotide probe
  misc_binding (1)..(16): Hybridization probe for the specific detection of wild-type HIV-1 at codon 225 of the reverse transcriptase gene.
raargaaccyccatty

SEQ ID NO: 5971 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (12)..(12): base is a locked nucleic acid
raargaaccyccatt

SEQ ID NO: 5972 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (11)..(11): base is a locked nucleic acid
raargaaccyccatt

SEQ ID NO: 5973 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (10)..(10): base is a locked nucleic acid
raargaaccyccatt

SEQ ID NO: 5974 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (1)..(1): base is a locked nucleic acid
raargaaccyccatt

SEQ ID NO: 5975 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (2)..(2): base is a locked nucleic acid
raargaaccyccatt

SEQ ID NO: 5976 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (6)..(6): base is a locked nucleic acid
raargaaccyccatt

SEQ ID NO: 5977 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (8)..(8): base is a locked nucleic acid
raargaaccyccatt

SEQ ID NO: 5978 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (15)..(15): base is a locked nucleic acid
raargaaccyccatt

SEQ ID NO: 5979 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (11)..(11): base is a locked nucleic acid
raargaaccyccatt

SEQ ID NO: 5980 - DNA, 16 bp, Artificial Sequence
  Oligonucleotide probe
  misc_binding (1)..(16): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
raargaaccyccatty

SEQ ID NO: 5981 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (12)..(12): base is a locked nucleic acid
raargaaccyccatt

SEQ ID NO: 5982 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (5)..(5): base is a locked nucleic acid
  modified_base (8)..(8): base is a locked nucleic acid
  modified_base (10)..(10): base is a locked nucleic acid
raargaaccyccatt

SEQ ID NO: 5983 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (3)..(3): base is a locked nucleic acid
  modified_base (8)..(8): base is a locked nucleic acid
  modified_base (10)..(10): base is a locked nucleic acid
raargaaccyccatt

SEQ ID NO: 5984 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (6)..(6): base is a locked nucleic acid
  modified_base (8)..(8): base is a locked nucleic acid
  modified_base (10)..(10): base is a locked nucleic acid
raargaaccyccatt

SEQ ID NO: 5985 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (7)..(7): base is a locked nucleic acid
  modified_base (8)..(8): base is a locked nucleic acid
  modified_base (10)..(10): base is a locked nucleic acid
raargaaccyccatt

SEQ ID NO: 5986 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
raargaaccyccatt

SEQ ID NO: 5987 - DNA, 14 bp, Artificial Sequence
  Oligonucleotide probe
  misc_binding (1)..(14): Hybridization probe for the specific detection of wild-type HIV-1 at codon 225 of the reverse transcriptase gene.
raargaaccyccat

SEQ ID NO: 5988 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (12)..(12): base is a locked nucleic acid
raargaaccycca

SEQ ID NO: 5989 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (11)..(11): base is a locked nucleic acid
raargaaccycca

SEQ ID NO: 5990 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (10)..(10): base is a locked nucleic acid
raargaaccycca

SEQ ID NO: 5991 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (1)..(1): base is a locked nucleic acid
raargaaccycca

SEQ ID NO: 5992 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (2)..(2): base is a locked nucleic acid
raargaaccycca

SEQ ID NO: 5993 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (6)..(6): base is a locked nucleic acid
raargaaccycca

SEQ ID NO: 5994 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (8)..(8): base is a locked nucleic acid
raargaaccycca

SEQ ID NO: 5995 - DNA, 14 bp, Artificial Sequence
  Oligonucleotide probe
  misc_binding (1)..(14): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
raargaaccyccat

SEQ ID NO: 5996 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (11)..(11): base is a locked nucleic acid
raargaaccycca

SEQ ID NO: 5997 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
  modified_base (12)..(12): base is a locked nucleic acid
raargaaccycca

SEQ ID NO: 5998 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (5)..(5): base is a locked nucleic acid
  modified_base (8)..(8): base is a locked nucleic acid
  modified_base (10)..(10): base is a locked nucleic acid
raargaaccycca

SEQ ID NO: 5999 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (3)..(3): base is a locked nucleic acid
  modified_base (8)..(8): base is a locked nucleic acid
  modified_base (10)..(10): base is a locked nucleic acid
raargaaccycca

SEQ ID NO: 6000 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (6)..(6): base is a locked nucleic acid
  modified_base (8)..(8): base is a locked nucleic acid
  modified_base (10)..(10): base is a locked nucleic acid
raargaaccycca

SEQ ID NO: 6001 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (7)..(7): base is a locked nucleic acid
  modified_base (8)..(8): base is a locked nucleic acid
  modified_base (10)..(10): base is a locked nucleic acid
raargaaccycca

SEQ ID NO: 6002 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
  modified_base (8)..(8): base is a locked nucleic acid
  modified_base (10)..(10): base is a locked nucleic acid
raargaaccycca

SEQ ID NO: 6003 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
  misc_feature (9)..(9): n is a, c, g, or t
aaagaaccnccattc

SEQ ID NO: 6004 - DNA, 19 bp, Artificial Sequence
  Oligonucleotide probe
  misc_binding (1)..(19): Hybridization probe for the specific detection of wild-type HIV-1 at codon 225 of the reverse transcriptase gene.
araargaaccyccattyct

SEQ ID NO: 6005 - DNA, 17 bp, Artificial Sequence
  Oligonucleotide probe
  misc_binding (1)..(17): Hybridization probe for the specific detection of wild-type HIV-1 at codon 225 of the reverse transcriptase gene.
raargaaccyccattyc

SEQ ID NO: 6006 - DNA, 15 bp, Artificial Sequence
  Oligonucleotide probe
  misc_binding (1)..(15): Hybridization probe for the specific detection of wild-type HIV-1 at codon 225 of the reverse transcriptase gene.
raargaaccyccatt

SEQ ID NO: 6007 - DNA, 13 bp, Artificial Sequence
  Oligonucleotide probe
  misc_binding (1)..(13): Hybridization probe for the specific detection of wild-type HIV-1 at codon 225 of the reverse transcriptase gene.
raargaaccycca

SEQ ID NO: 6008 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (12)..(12): base is a locked nucleic acid
gaaccyccattyctttgga

SEQ ID NO: 6009 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (12)..(12): base is a locked nucleic acid
aaccyccattyctttggat

SEQ ID NO: 6010 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (14)..(14): base is a locked nucleic acid
gaaccyccattyctttgga

SEQ ID NO: 6011 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (15)..(15): base is a locked nucleic acid
aaccyccattyctttggat

SEQ ID NO: 6012 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (17)..(17): base is a locked nucleic acid
gaaccyccattyctttgga

SEQ ID NO: 6013 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (18)..(18): base is a locked nucleic acid
aaccyccattyctttggat

SEQ ID NO: 6014 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (15)..(15): base is a locked nucleic acid
gaaccyccattyctttgga

SEQ ID NO: 6015 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (16)..(16): base is a locked nucleic acid
aaccyccattyctttggat

SEQ ID NO: 6016 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (4)..(4): base is a locked nucleic acid
gaaccyccattyctttgga

SEQ ID NO: 6017 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (5)..(5): base is a locked nucleic acid
aaccyccattyctttggat

SEQ ID NO: 6018 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (3)..(3): base is a locked nucleic acid
gaaccyccattyctttgga

SEQ ID NO: 6019 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (7)..(7): base is a locked nucleic acid
aaccyccattyctttggat

SEQ ID NO: 6020 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (7)..(7): base is a locked nucleic acid
gaaccyccattyctttgga

SEQ ID NO: 6021 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (2)..(2): base is a locked nucleic acid
aaccyccattyctttggat

SEQ ID NO: 6022 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (8)..(8): base is a locked nucleic acid
gaaccyccattyctttgga

SEQ ID NO: 6023 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
aaccyccattyctttggat

SEQ ID NO: 6024 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (12)..(12): base is a locked nucleic acid
gaaccyccattyctttgga

SEQ ID NO: 6025 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (17)..(17): base is a locked nucleic acid
aaccyccattyctttggat

SEQ ID NO: 6026 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (15)..(15): base is a locked nucleic acid
gaaccyccattyctttgga

SEQ ID NO: 6027 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (18)..(18): base is a locked nucleic acid
aaccyccattyctttggat

SEQ ID NO: 6028 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (14)..(14): base is a locked nucleic acid
gaaccyccattyctttgga

SEQ ID NO: 6029 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (14)..(14): base is a locked nucleic acid
aaccyccattyctttggat

SEQ ID NO: 6030 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (16)..(16): base is a locked nucleic acid
gaaccyccattyctttgga

SEQ ID NO: 6031 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
  modified_base (13)..(13): base is a locked nucleic acid
aaccyccattyctttggat

SEQ ID NO: 6032 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (8)..(8): base is a locked nucleic acid
  modified_base (9)..(9): base is a locked nucleic acid
  modified_base (11)..(11): base is a locked nucleic acid
gaaccyccattyctttgga

SEQ ID NO: 6033 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (5)..(5): base is a locked nucleic acid
  modified_base (9)..(9): base is a locked nucleic acid
  modified_base (11)..(11): base is a locked nucleic acid
aaccyccattyctttggat

SEQ ID NO: 6034 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (7)..(7): base is a locked nucleic acid
  modified_base (9)..(9): base is a locked nucleic acid
  modified_base (11)..(11): base is a locked nucleic acid
gaaccyccattyctttgga

SEQ ID NO: 6035 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (4)..(4): base is a locked nucleic acid
  modified_base (9)..(9): base is a locked nucleic acid
  modified_base (11)..(11): base is a locked nucleic acid
aaccyccattyctttggat

SEQ ID NO: 6036 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (4)..(4): base is a locked nucleic acid
  modified_base (9)..(9): base is a locked nucleic acid
  modified_base (11)..(11): base is a locked nucleic acid
gaaccyccattyctttgga

SEQ ID NO: 6037 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (2)..(2): base is a locked nucleic acid
  modified_base (9)..(9): base is a locked nucleic acid
  modified_base (11)..(11): base is a locked nucleic acid
aaccyccattyctttggat

SEQ ID NO: 6038 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (3)..(3): base is a locked nucleic acid
  modified_base (9)..(9): base is a locked nucleic acid
  modified_base (11)..(11): base is a locked nucleic acid
gaaccyccattyctttgga

SEQ ID NO: 6039 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (8)..(8): base is a locked nucleic acid
  modified_base (9)..(9): base is a locked nucleic acid
  modified_base (11)..(11): base is a locked nucleic acid
aaccyccattyctttggat

SEQ ID NO: 6040 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
gaaccyccattyctttgga

SEQ ID NO: 6041 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
  modified_base (9)..(9): base is a locked nucleic acid
  modified_base (11)..(11): base is a locked nucleic acid
aaccyccattyctttggat

SEQ ID NO: 6042 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (11)..(11): base is a locked nucleic acid
aaccyccattyctttgg

SEQ ID NO: 6043 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (11)..(11): base is a locked nucleic acid
accyccattyctttgga

SEQ ID NO: 6044 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (13)..(13): base is a locked nucleic acid
aaccyccattyctttgg

SEQ ID NO: 6045 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (14)..(14): base is a locked nucleic acid
accyccattyctttgga

SEQ ID NO: 6046 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (16)..(16): base is a locked nucleic acid
aaccyccattyctttgg

SEQ ID NO: 6047 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (17)..(17): base is a locked nucleic acid
accyccattyctttgga

SEQ ID NO: 6048 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (14)..(14): base is a locked nucleic acid
aaccyccattyctttgg

SEQ ID NO: 6049 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (15)..(15): base is a locked nucleic acid
accyccattyctttgga

SEQ ID NO: 6050 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (3)..(3): base is a locked nucleic acid
aaccyccattyctttgg

SEQ ID NO: 6051 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (4)..(4): base is a locked nucleic acid
accyccattyctttgga

SEQ ID NO: 6052 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (2)..(2): base is a locked nucleic acid
aaccyccattyctttgg

SEQ ID NO: 6053 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (6)..(6): base is a locked nucleic acid
accyccattyctttgga

SEQ ID NO: 6054 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (6)..(6): base is a locked nucleic acid
aaccyccattyctttgg

SEQ ID NO: 6055 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (1)..(1): base is a locked nucleic acid
accyccattyctttgga

SEQ ID NO: 6056 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (7)..(7): base is a locked nucleic acid
aaccyccattyctttgg

SEQ ID NO: 6057 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
accyccattyctttgga

SEQ ID NO: 6058 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (11)..(11): base is a locked nucleic acid
aaccyccattyctttgg

SEQ ID NO: 6059 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (16)..(16): base is a locked nucleic acid
accyccattyctttgga

SEQ ID NO: 6060 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (14)..(14): base is a locked nucleic acid
aaccyccattyctttgg

SEQ ID NO: 6061 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (17)..(17): base is a locked nucleic acid
accyccattyctttgga

SEQ ID NO: 6062 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (13)..(13): base is a locked nucleic acid
aaccyccattyctttgg

SEQ ID NO: 6063 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (13)..(13): base is a locked nucleic acid
accyccattyctttgga

SEQ ID NO: 6064 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (15)..(15): base is a locked nucleic acid
aaccyccattyctttgg

SEQ ID NO: 6065 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (12)..(12): base is a locked nucleic acid
accyccattyctttgga

SEQ ID NO: 6066 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (7)..(7): base is a locked nucleic acid
  modified_base (8)..(8): base is a locked nucleic acid
  modified_base (10)..(10): base is a locked nucleic acid
aaccyccattyctttgg

SEQ ID NO: 6067 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (4)..(4): base is a locked nucleic acid
  modified_base (8)..(8): base is a locked nucleic acid
  modified_base (10)..(10): base is a locked nucleic acid
accyccattyctttgga

SEQ ID NO: 6068 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (6)..(6): base is a locked nucleic acid
  modified_base (8)..(8): base is a locked nucleic acid
  modified_base (10)..(10): base is a locked nucleic acid
aaccyccattyctttgg

SEQ ID NO: 6069 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (3)..(3): base is a locked nucleic acid
  modified_base (8)..(8): base is a locked nucleic acid
  modified_base (10)..(10): base is a locked nucleic acid
accyccattyctttgga

SEQ ID NO: 6070 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (3)..(3): base is a locked nucleic acid
  modified_base (8)..(8): base is a locked nucleic acid
  modified_base (10)..(10): base is a locked nucleic acid
aaccyccattyctttgg

SEQ ID NO: 6071 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (1)..(1): base is a locked nucleic acid
  modified_base (8)..(8): base is a locked nucleic acid
  modified_base (10)..(10): base is a locked nucleic acid
accyccattyctttgga

SEQ ID NO: 6072 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (2)..(2): base is a locked nucleic acid
  modified_base (8)..(8): base is a locked nucleic acid
  modified_base (10)..(10): base is a locked nucleic acid
aaccyccattyctttgg

SEQ ID NO: 6073 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (7)..(7): base is a locked nucleic acid
  modified_base (8)..(8): base is a locked nucleic acid
  modified_base (10)..(10): base is a locked nucleic acid
accyccattyctttgga

SEQ ID NO: 6074 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
aaccyccattyctttgg

SEQ ID NO: 6075 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
accyccattyctttgga

SEQ ID NO: 6076 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (11)..(11): base is a locked nucleic acid
aaccyccattycttt

SEQ ID NO: 6077 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (11)..(11): base is a locked nucleic acid
accyccattyctttg

SEQ ID NO: 6078 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (13)..(13): base is a locked nucleic acid
aaccyccattycttt

SEQ ID NO: 6079 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (14)..(14): base is a locked nucleic acid
accyccattyctttg

SEQ ID NO: 6080 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
aaccyccattycttt

SEQ ID NO: 6081 - DNA, 16 bp, Artificial Sequence
  Oligonucleotide probe
  misc_binding (1)..(16): Hybridization probe for the specific detection of wild-type HIV-1 at codon 227 of the reverse transcriptase gene.
accyccattyctttgg

SEQ ID NO: 6082 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (14)..(14): base is a locked nucleic acid
aaccyccattycttt

SEQ ID NO: 6083 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (15)..(15): base is a locked nucleic acid
accyccattyctttg

SEQ ID NO: 6084 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (3)..(3): base is a locked nucleic acid
aaccyccattycttt

SEQ ID NO: 6085 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (4)..(4): base is a locked nucleic acid
accyccattyctttg

SEQ ID NO: 6086 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (2)..(2): base is a locked nucleic acid
aaccyccattycttt

SEQ ID NO: 6087 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (6)..(6): base is a locked nucleic acid
accyccattyctttg

SEQ ID NO: 6088 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (6)..(6): base is a locked nucleic acid
aaccyccattycttt

SEQ ID NO: 6089 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (1)..(1): base is a locked nucleic acid
accyccattyctttg

SEQ ID NO: 6090 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (7)..(7): base is a locked nucleic acid
aaccyccattycttt

SEQ ID NO: 6091 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
accyccattyctttg

SEQ ID NO: 6092 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (11)..(11): base is a locked nucleic acid
aaccyccattycttt

SEQ ID NO: 6093 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
accyccattyctttg

SEQ ID NO: 6094 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (14)..(14): base is a locked nucleic acid
aaccyccattycttt

SEQ ID NO: 6095 - DNA, 16 bp, Artificial Sequence
  Oligonucleotide probe
  misc_binding (1)..(16): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
accyccattyctttgg

SEQ ID NO: 6096 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (13)..(13): base is a locked nucleic acid
aaccyccattycttt

SEQ ID NO: 6097 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (13)..(13): base is a locked nucleic acid
accyccattyctttg

SEQ ID NO: 6098 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (15)..(15): base is a locked nucleic acid
aaccyccattycttt

SEQ ID NO: 6099 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (12)..(12): base is a locked nucleic acid
accyccattyctttg

SEQ ID NO: 6100 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (7)..(7): base is a locked nucleic acid
  modified_base (8)..(8): base is a locked nucleic acid
  modified_base (10)..(10): base is a locked nucleic acid
aaccyccattycttt

SEQ ID NO: 6101 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (4)..(4): base is a locked nucleic acid
  modified_base (8)..(8): base is a locked nucleic acid
  modified_base (10)..(10): base is a locked nucleic acid
accyccattyctttg

SEQ ID NO: 6102 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (6)..(6): base is a locked nucleic acid
  modified_base (8)..(8): base is a locked nucleic acid
  modified_base (10)..(10): base is a locked nucleic acid
aaccyccattycttt

SEQ ID NO: 6103 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (3)..(3): base is a locked nucleic acid
  modified_base (8)..(8): base is a locked nucleic acid
  modified_base (10)..(10): base is a locked nucleic acid
accyccattyctttg

SEQ ID NO: 6104 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (3)..(3): base is a locked nucleic acid
  modified_base (8)..(8): base is a locked nucleic acid
  modified_base (10)..(10): base is a locked nucleic acid
aaccyccattycttt

SEQ ID NO: 6105 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (1)..(1): base is a locked nucleic acid
  modified_base (8)..(8): base is a locked nucleic acid
  modified_base (10)..(10): base is a locked nucleic acid
accyccattyctttg

SEQ ID NO: 6106 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (2)..(2): base is a locked nucleic acid
  modified_base (8)..(8): base is a locked nucleic acid
  modified_base (10)..(10): base is a locked nucleic acid
aaccyccattycttt

SEQ ID NO: 6107 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (7)..(7): base is a locked nucleic acid
  modified_base (8)..(8): base is a locked nucleic acid
  modified_base (10)..(10): base is a locked nucleic acid
accyccattyctttg

SEQ ID NO: 6108 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
aaccyccattycttt

SEQ ID NO: 6109 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
accyccattyctttg

SEQ ID NO: 6110 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (11)..(11): base is a locked nucleic acid
aaccyccattyct

SEQ ID NO: 6111 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (11)..(11): base is a locked nucleic acid
accyccattyctt

SEQ ID NO: 6112 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (13)..(13): base is a locked nucleic acid
aaccyccattyct

SEQ ID NO: 6113 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
accyccattyctt

SEQ ID NO: 6114 - DNA, 14 bp, Artificial Sequence
  Oligonucleotide probe
  misc_binding (1)..(14): Hybridization probe for the specific detection of wild-type HIV-1 at codon 227 of the reverse transcriptase gene.
aaccyccattyctt

SEQ ID NO: 6115 - DNA, 14 bp, Artificial Sequence
  Oligonucleotide probe
  misc_binding (1)..(14): Hybridization probe for the specific detection of wild-type HIV-1 at codon 227 of the reverse transcriptase gene.
accyccattycttt

SEQ ID NO: 6116 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
aaccyccattyct

SEQ ID NO: 6117 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (3)..(3): base is a locked nucleic acid
aaccyccattyct

SEQ ID NO: 6118 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (4)..(4): base is a locked nucleic acid
accyccattyctt

SEQ ID NO: 6119 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (2)..(2): base is a locked nucleic acid
aaccyccattyct

SEQ ID NO: 6120 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (6)..(6): base is a locked nucleic acid
accyccattyctt

SEQ ID NO: 6121 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (6)..(6): base is a locked nucleic acid
aaccyccattyct

SEQ ID NO: 6122 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (1)..(1): base is a locked nucleic acid
accyccattyctt

SEQ ID NO: 6123 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (7)..(7): base is a locked nucleic acid
aaccyccattyct

SEQ ID NO: 6124 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
accyccattyctt

SEQ ID NO: 6125 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (11)..(11): base is a locked nucleic acid
aaccyccattyct

SEQ ID NO: 6126 - DNA, 14 bp, Artificial Sequence
  Oligonucleotide probe
  misc_binding (1)..(14): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
accyccattycttt

SEQ ID NO: 6127 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
aaccyccattyct

SEQ ID NO: 6128 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (13)..(13): base is a locked nucleic acid
aaccyccattyct

SEQ ID NO: 6129 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (13)..(13): base is a locked nucleic acid
accyccattyctt

SEQ ID NO: 6130 - DNA, 14 bp, Artificial Sequence
  Oligonucleotide probe
  misc_binding (1)..(14): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
aaccyccattyctt

SEQ ID NO: 6131 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
  modified_base (12)..(12): base is a locked nucleic acid
accyccattyctt

SEQ ID NO: 6132 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (7)..(7): base is a locked nucleic acid
  modified_base (8)..(8): base is a locked nucleic acid
  modified_base (10)..(10): base is a locked nucleic acid
aaccyccattyct

SEQ ID NO: 6133 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (4)..(4): base is a locked nucleic acid
  modified_base (8)..(8): base is a locked nucleic acid
  modified_base (10)..(10): base is a locked nucleic acid
accyccattyctt

SEQ ID NO: 6134 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (6)..(6): base is a locked nucleic acid
  modified_base (8)..(8): base is a locked nucleic acid
  modified_base (10)..(10): base is a locked nucleic acid
aaccyccattyct

SEQ ID NO: 6135 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (3)..(3): base is a locked nucleic acid
  modified_base (8)..(8): base is a locked nucleic acid
  modified_base (10)..(10): base is a locked nucleic acid
accyccattyctt

SEQ ID NO: 6136 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (3)..(3): base is a locked nucleic acid
  modified_base (8)..(8): base is a locked nucleic acid
  modified_base (10)..(10): base is a locked nucleic acid
aaccyccattyct

SEQ ID NO: 6137 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (1)..(1): base is a locked nucleic acid
  modified_base (8)..(8): base is a locked nucleic acid
  modified_base (10)..(10): base is a locked nucleic acid
accyccattyctt

SEQ ID NO: 6138 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (2)..(2): base is a locked nucleic acid
  modified_base (8)..(8): base is a locked nucleic acid
  modified_base (10)..(10): base is a locked nucleic acid
aaccyccattyct

SEQ ID NO: 6139 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (7)..(7): base is a locked nucleic acid
  modified_base (8)..(8): base is a locked nucleic acid
  modified_base (10)..(10): base is a locked nucleic acid
accyccattyctt

SEQ ID NO: 6140 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
aaccyccattyct

SEQ ID NO: 6141 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
  modified_base (8)..(8): base is a locked nucleic acid
  modified_base (10)..(10): base is a locked nucleic acid
accyccattyctt

SEQ ID NO: 6142 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
cctccattyctttgg

SEQ ID NO: 6143 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
gaaccyccattyctttgga

SEQ ID NO: 6144 - DNA, 19 bp, Artificial Sequence
  Oligonucleotide probe
  misc_binding (1)..(19): Hybridization probe for the specific detection of wild-type HIV-1 at codon 227 of the reverse transcriptase gene.
aaccyccattyctttggat

SEQ ID NO: 6145 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
aaccyccattyctttgg

SEQ ID NO: 6146 - DNA, 17 bp, Artificial Sequence
  Oligonucleotide probe
  misc_binding (1)..(17): Hybridization probe for the specific detection of wild-type HIV-1 at codon 227 of the reverse transcriptase gene.
accyccattyctttgga

SEQ ID NO: 6147 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
aaccyccattycttt

SEQ ID NO: 6148 - DNA, 15 bp, Artificial Sequence
  Oligonucleotide probe
  misc_binding (1)..(15): Hybridization probe for the specific detection of wild-type HIV-1 at codon 227 of the reverse transcriptase gene.
accyccattyctttg

SEQ ID NO: 6149 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
aaccyccattyct

SEQ ID NO: 6150 - DNA, 13 bp, Artificial Sequence
  Oligonucleotide probe
  misc_binding (1)..(13): Hybridization probe for the specific detection of wild-type HIV-1 at codon 227 of the reverse transcriptase gene.
accyccattyctt

SEQ ID NO: 6151 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (15)..(15): base is a locked nucleic acid
ttyctttggatgggdtatg

SEQ ID NO: 6152 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (13)..(13): base is a locked nucleic acid
ttyctttggatgggdtatg

SEQ ID NO: 6153 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (17)..(17): base is a locked nucleic acid
ttyctttggatgggdtatg

SEQ ID NO: 6154 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (19)..(19): base is a locked nucleic acid
ttyctttggatgggdtatg

SEQ ID NO: 6155 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (9)..(9): base is a locked nucleic acid
ttyctttggatgggdtatg

SEQ ID NO: 6156 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (7)..(7): base is a locked nucleic acid
ttyctttggatgggdtatg

SEQ ID NO: 6157 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (3)..(3): base is a locked nucleic acid
ttyctttggatgggdtatg

SEQ ID NO: 6158 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (6)..(6): base is a locked nucleic acid
ttyctttggatgggdtatg

SEQ ID NO: 6159 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (9)..(9): base is a locked nucleic acid
  modified_base (11)..(11): base is a locked nucleic acid
  modified_base (19)..(19): base is a locked nucleic acid
ttyctttggatgggdtatg

SEQ ID NO: 6160 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (9)..(9): base is a locked nucleic acid
  modified_base (11)..(11): base is a locked nucleic acid
  modified_base (16)..(16): base is a locked nucleic acid
ttyctttggatgggdtatg

SEQ ID NO: 6161 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (9)..(9): base is a locked nucleic acid
  modified_base (11)..(11): base is a locked nucleic acid
  modified_base (14)..(14): base is a locked nucleic acid
ttyctttggatgggdtatg

SEQ ID NO: 6162 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (9)..(9): base is a locked nucleic acid
  modified_base (11)..(11): base is a locked nucleic acid
  modified_base (12)..(12): base is a locked nucleic acid
ttyctttggatgggdtatg

SEQ ID NO: 6163 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (4)..(4): base is a locked nucleic acid
  modified_base (9)..(9): base is a locked nucleic acid
  modified_base (11)..(11): base is a locked nucleic acid
ttyctttggatgggdtatg

SEQ ID NO: 6164 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (2)..(2): base is a locked nucleic acid
  modified_base (9)..(9): base is a locked nucleic acid
  modified_base (11)..(11): base is a locked nucleic acid
ttyctttggatgggdtatg

SEQ ID NO: 6165 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (3)..(3): base is a locked nucleic acid
  modified_base (9)..(9): base is a locked nucleic acid
  modified_base (11)..(11): base is a locked nucleic acid
ttyctttggatgggdtatg

SEQ ID NO: 6166 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (8)..(8): base is a locked nucleic acid
  modified_base (9)..(9): base is a locked nucleic acid
  modified_base (11)..(11): base is a locked nucleic acid
ttyctttggatgggdtatg

SEQ ID NO: 6167 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
  modified_base (9)..(9): base is a locked nucleic acid
  modified_base (11)..(11): base is a locked nucleic acid
ttyctttggatgggdtatg

SEQ ID NO: 6168 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (14)..(14): base is a locked nucleic acid
tyctttggatgggdtat

SEQ ID NO: 6169 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (12)..(12): base is a locked nucleic acid
tyctttggatgggdtat

SEQ ID NO: 6170 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (16)..(16): base is a locked nucleic acid
tyctttggatgggdtat

SEQ ID NO: 6171 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
tyctttggatgggdtat

SEQ ID NO: 6172 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (8)..(8): base is a locked nucleic acid
tyctttggatgggdtat

SEQ ID NO: 6173 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (6)..(6): base is a locked nucleic acid
tyctttggatgggdtat

SEQ ID NO: 6174 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (2)..(2): base is a locked nucleic acid
tyctttggatgggdtat

SEQ ID NO: 6175 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (5)..(5): base is a locked nucleic acid
tyctttggatgggdtat

SEQ ID NO: 6176 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
tyctttggatgggdtat

SEQ ID NO: 6177 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (15)..(15): base is a locked nucleic acid
tyctttggatgggdtat

SEQ ID NO: 6178 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (13)..(13): base is a locked nucleic acid
tyctttggatgggdtat

SEQ ID NO: 6179 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (11)..(11): base is a locked nucleic acid
tyctttggatgggdtat

SEQ ID NO: 6180 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (3)..(3): base is a locked nucleic acid
  modified_base (8)..(8): base is a locked nucleic acid
  modified_base (10)..(10): base is a locked nucleic acid
tyctttggatgggdtat

SEQ ID NO: 6181 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (1)..(1): base is a locked nucleic acid
  modified_base (8)..(8): base is a locked nucleic acid
  modified_base (10)..(10): base is a locked nucleic acid
tyctttggatgggdtat

SEQ ID NO: 6182 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (2)..(2): base is a locked nucleic acid
  modified_base (8)..(8): base is a locked nucleic acid
  modified_base (10)..(10): base is a locked nucleic acid
tyctttggatgggdtat

SEQ ID NO: 6183 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (7)..(7): base is a locked nucleic acid
  modified_base (8)..(8): base is a locked nucleic acid
  modified_base (10)..(10): base is a locked nucleic acid
tyctttggatgggdtat

SEQ ID NO: 6184 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
tyctttggatgggdtat

SEQ ID NO: 6185 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (14)..(14): base is a locked nucleic acid
tyctttggatgggdt

SEQ ID NO: 6186 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (12)..(12): base is a locked nucleic acid
tyctttggatgggdt

SEQ ID NO: 6187 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
tyctttggatgggdt

SEQ ID NO: 6188 - DNA, 16 bp, Artificial Sequence
  Oligonucleotide probe
  misc_binding (1)..(16): Hybridization probe for the specific detection of wild-type HIV-1 at codon 230 of the reverse transcriptase gene.
tyctttggatgggdta

SEQ ID NO: 6189 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (8)..(8): base is a locked nucleic acid
tyctttggatgggdt

SEQ ID NO: 6190 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (6)..(6): base is a locked nucleic acid
tyctttggatgggdt

SEQ ID NO: 6191 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (2)..(2): base is a locked nucleic acid
tyctttggatgggdt

SEQ ID NO: 6192 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (5)..(5): base is a locked nucleic acid
tyctttggatgggdt

SEQ ID NO: 6193 - DNA, 16 bp, Artificial Sequence
  Oligonucleotide probe
  misc_binding (1)..(16): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
tyctttggatgggdta

SEQ ID NO: 6194 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (15)..(15): base is a locked nucleic acid
tyctttggatgggdt

SEQ ID NO: 6195 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (13)..(13): base is a locked nucleic acid
tyctttggatgggdt

SEQ ID NO: 6196 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (11)..(11): base is a locked nucleic acid
tyctttggatgggdt

SEQ ID NO: 6197 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (3)..(3): base is a locked nucleic acid
  modified_base (8)..(8): base is a locked nucleic acid
  modified_base (10)..(10): base is a locked nucleic acid
tyctttggatgggdt

SEQ ID NO: 6198 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (1)..(1): base is a locked nucleic acid
  modified_base (8)..(8): base is a locked nucleic acid
  modified_base (10)..(10): base is a locked nucleic acid
tyctttggatgggdt

SEQ ID NO: 6199 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (2)..(2): base is a locked nucleic acid
  modified_base (8)..(8): base is a locked nucleic acid
  modified_base (10)..(10): base is a locked nucleic acid
tyctttggatgggdt

SEQ ID NO: 6200 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (7)..(7): base is a locked nucleic acid
  modified_base (8)..(8): base is a locked nucleic acid
  modified_base (10)..(10): base is a locked nucleic acid
tyctttggatgggdt

SEQ ID NO: 6201 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
tyctttggatgggdt

SEQ ID NO: 6202 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
tyctttggatggg

SEQ ID NO: 6203 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (12)..(12): base is a locked nucleic acid
tyctttggatggg

SEQ ID NO: 6204 - DNA, 14 bp, Artificial Sequence
  Oligonucleotide probe
  misc_binding (1)..(14): Hybridization probe for the specific detection of wild-type HIV-1 at codon 230 of the reverse transcriptase gene.
tyctttggatgggd

SEQ ID NO: 6205 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (8)..(8): base is a locked nucleic acid
tyctttggatggg

SEQ ID NO: 6206 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (6)..(6): base is a locked nucleic acid
tyctttggatggg

SEQ ID NO: 6207 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (2)..(2): base is a locked nucleic acid
tyctttggatggg

SEQ ID NO: 6208 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (5)..(5): base is a locked nucleic acid
tyctttggatggg

SEQ ID NO: 6209 - DNA, 14 bp, Artificial Sequence
  Oligonucleotide probe
  misc_binding (1)..(14): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
tyctttggatgggd

SEQ ID NO: 6210 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (13)..(13): base is a locked nucleic acid
tyctttggatggg

SEQ ID NO: 6211 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
  modified_base (11)..(11): base is a locked nucleic acid
tyctttggatggg

SEQ ID NO: 6212 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (3)..(3): base is a locked nucleic acid
  modified_base (8)..(8): base is a locked nucleic acid
  modified_base (10)..(10): base is a locked nucleic acid
tyctttggatggg

SEQ ID NO: 6213 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (1)..(1): base is a locked nucleic acid
  modified_base (8)..(8): base is a locked nucleic acid
  modified_base (10)..(10): base is a locked nucleic acid
tyctttggatggg

SEQ ID NO: 6214 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (2)..(2): base is a locked nucleic acid
  modified_base (8)..(8): base is a locked nucleic acid
  modified_base (10)..(10): base is a locked nucleic acid
tyctttggatggg

SEQ ID NO: 6215 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (7)..(7): base is a locked nucleic acid
  modified_base (8)..(8): base is a locked nucleic acid
  modified_base (10)..(10): base is a locked nucleic acid
tyctttggatggg

SEQ ID NO: 6216 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
  modified_base (8)..(8): base is a locked nucleic acid
  modified_base (10)..(10): base is a locked nucleic acid
tyctttggatggg

SEQ ID NO: 6217 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
cctttggatgggtta

SEQ ID NO: 6218 - DNA, 19 bp, Artificial Sequence
  Oligonucleotide probe
  misc_binding (1)..(19): Hybridization probe for the specific detection of wild-type HIV-1 at codon 230 of the reverse transcriptase gene.
ttyctttggatgggdtatg

SEQ ID NO: 6219 - DNA, 17 bp, Artificial Sequence
  Oligonucleotide probe
  misc_binding (1)..(17): Hybridization probe for the specific detection of wild-type HIV-1 at codon 230 of the reverse transcriptase gene.
tyctttggatgggdtat

SEQ ID NO: 6220 - DNA, 15 bp, Artificial Sequence
  Oligonucleotide probe
  misc_binding (1)..(15): Hybridization probe for the specific detection of wild-type HIV-1 at codon 230 of the reverse transcriptase gene.
tyctttggatgggdt

SEQ ID NO: 6221 - DNA, 13 bp, Artificial Sequence
  Oligonucleotide probe
  misc_binding (1)..(13): Hybridization probe for the specific detection of wild-type HIV-1 at codon 230 of the reverse transcriptase gene.
tyctttggatggg

SEQ ID NO: 6222 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (12)..(12): base is a locked nucleic acid
atcctgayaartggacagt

SEQ ID NO: 6223 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (16)..(16): base is a locked nucleic acid
atcctgayaartggacagt

SEQ ID NO: 6224 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (19)..(19): base is a locked nucleic acid
atcctgayaartggacagt

SEQ ID NO: 6225 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (13)..(13): base is a locked nucleic acid
atcctgayaartggacagt

SEQ ID NO: 6226 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (7)..(7): base is a locked nucleic acid
atcctgayaartggacagt

SEQ ID NO: 6227 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (8)..(8): base is a locked nucleic acid
atcctgayaartggacagt

SEQ ID NO: 6228 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (4)..(4): base is a locked nucleic acid
atcctgayaartggacagt

SEQ ID NO: 6229 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (2)..(2): base is a locked nucleic acid
atcctgayaartggacagt

SEQ ID NO: 6230 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (18)..(18): base is a locked nucleic acid
atcctgayaartggacagt

SEQ ID NO: 6231 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (14)..(14): base is a locked nucleic acid
atcctgayaartggacagt

SEQ ID NO: 6232 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (16)..(16): base is a locked nucleic acid
atcctgayaartggacagt

SEQ ID NO: 6233 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (17)..(17): base is a locked nucleic acid
atcctgayaartggacagt

SEQ ID NO: 6234 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (3)..(3): base is a locked nucleic acid
  modified_base (9)..(9): base is a locked nucleic acid
  modified_base (11)..(11): base is a locked nucleic acid
atcctgayaartggacagt

SEQ ID NO: 6235 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (6)..(6): base is a locked nucleic acid
  modified_base (9)..(9): base is a locked nucleic acid
  modified_base (11)..(11): base is a locked nucleic acid
atcctgayaartggacagt

SEQ ID NO: 6236 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (8)..(8): base is a locked nucleic acid
  modified_base (9)..(9): base is a locked nucleic acid
  modified_base (11)..(11): base is a locked nucleic acid
atcctgayaartggacagt

SEQ ID NO: 6237 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (4)..(4): base is a locked nucleic acid
  modified_base (9)..(9): base is a locked nucleic acid
  modified_base (11)..(11): base is a locked nucleic acid
atcctgayaartggacagt

SEQ ID NO: 6238 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartggacagt

SEQ ID NO: 6239 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (12)..(12): base is a locked nucleic acid
atcctgayaartggaca

SEQ ID NO: 6240 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (16)..(16): base is a locked nucleic acid
atcctgayaartggaca

SEQ ID NO: 6241 - DNA, 18 bp, Artificial Sequence
  Oligonucleotide probe
  misc_binding (1)..(18): Hybridization probe for the specific detection of wild-type HIV-1 at codon 238 of the reverse transcriptase gene.
atcctgayaartggacag

SEQ ID NO: 6242 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (13)..(13): base is a locked nucleic acid
atcctgayaartggaca

SEQ ID NO: 6243 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (7)..(7): base is a locked nucleic acid
atcctgayaartggaca

SEQ ID NO: 6244 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (8)..(8): base is a locked nucleic acid
atcctgayaartggaca

SEQ ID NO: 6245 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (4)..(4): base is a locked nucleic acid
atcctgayaartggaca

SEQ ID NO: 6246 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (2)..(2): base is a locked nucleic acid
atcctgayaartggaca

SEQ ID NO: 6247 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartggaca

SEQ ID NO: 6248 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (14)..(14): base is a locked nucleic acid
atcctgayaartggaca

SEQ ID NO: 6249 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (16)..(16): base is a locked nucleic acid
atcctgayaartggaca

SEQ ID NO: 6250 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (17)..(17): base is a locked nucleic acid
atcctgayaartggaca

SEQ ID NO: 6251 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (3)..(3): base is a locked nucleic acid
  modified_base (9)..(9): base is a locked nucleic acid
  modified_base (11)..(11): base is a locked nucleic acid
atcctgayaartggaca

SEQ ID NO: 6252 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (6)..(6): base is a locked nucleic acid
  modified_base (9)..(9): base is a locked nucleic acid
  modified_base (11)..(11): base is a locked nucleic acid
atcctgayaartggaca

SEQ ID NO: 6253 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (8)..(8): base is a locked nucleic acid
  modified_base (9)..(9): base is a locked nucleic acid
  modified_base (11)..(11): base is a locked nucleic acid
atcctgayaartggaca

SEQ ID NO: 6254 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (4)..(4): base is a locked nucleic acid
  modified_base (9)..(9): base is a locked nucleic acid
  modified_base (11)..(11): base is a locked nucleic acid
atcctgayaartggaca

SEQ ID NO: 6255 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartggaca

SEQ ID NO: 6256 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (12)..(12): base is a locked nucleic acid
atcctgayaartgga

SEQ ID NO: 6257 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
atcctgayaartgga

SEQ ID NO: 6258 - DNA, 16 bp, Artificial Sequence
  Oligonucleotide probe
  misc_binding (1)..(16): Hybridization probe for the specific detection of wild-type HIV-1 at codon 238 of the reverse transcriptase gene.
atcctgayaartggac

SEQ ID NO: 6259 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (13)..(13): base is a locked nucleic acid
atcctgayaartgga

SEQ ID NO: 6260 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (7)..(7): base is a locked nucleic acid
atcctgayaartgga

SEQ ID NO: 6261 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (8)..(8): base is a locked nucleic acid
atcctgayaartgga

SEQ ID NO: 6262 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (4)..(4): base is a locked nucleic acid
atcctgayaartgga

SEQ ID NO: 6263 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (2)..(2): base is a locked nucleic acid
atcctgayaartgga

SEQ ID NO: 6264 - DNA, 16 bp, Artificial Sequence
  Oligonucleotide probe
  misc_binding (1)..(16): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartggac

SEQ ID NO: 6265 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
  modified_base (14)..(14): base is a locked nucleic acid
atcctgayaartgga

SEQ ID NO: 6266 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartgga

SEQ ID NO: 6267 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (3)..(3): base is a locked nucleic acid
  modified_base (9)..(9): base is a locked nucleic acid
  modified_base (11)..(11): base is a locked nucleic acid
atcctgayaartgga

SEQ ID NO: 6268 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (6)..(6): base is a locked nucleic acid
  modified_base (9)..(9): base is a locked nucleic acid
  modified_base (11)..(11): base is a locked nucleic acid
atcctgayaartgga

SEQ ID NO: 6269 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (8)..(8): base is a locked nucleic acid
  modified_base (9)..(9): base is a locked nucleic acid
  modified_base (11)..(11): base is a locked nucleic acid
atcctgayaartgga

SEQ ID NO: 6270 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (4)..(4): base is a locked nucleic acid
  modified_base (9)..(9): base is a locked nucleic acid
  modified_base (11)..(11): base is a locked nucleic acid
atcctgayaartgga

SEQ ID NO: 6271 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartgga

SEQ ID NO: 6272 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (12)..(12): base is a locked nucleic acid
atcctgayaartg

SEQ ID NO: 6273 - DNA, 14 bp, Artificial Sequence
  Oligonucleotide probe
  misc_binding (1)..(14): Hybridization probe for the specific detection of wild-type HIV-1 at codon 238 of the reverse transcriptase gene.
atcctgayaartgg

SEQ ID NO: 6274 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (13)..(13): base is a locked nucleic acid
atcctgayaartg

SEQ ID NO: 6275 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (7)..(7): base is a locked nucleic acid
atcctgayaartg

SEQ ID NO: 6276 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (8)..(8): base is a locked nucleic acid
atcctgayaartg

SEQ ID NO: 6277 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (4)..(4): base is a locked nucleic acid
atcctgayaartg

SEQ ID NO: 6278 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (2)..(2): base is a locked nucleic acid
atcctgayaartg

SEQ ID NO: 6279 - DNA, 14 bp, Artificial Sequence
  Oligonucleotide probe
  misc_binding (1)..(14): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartgg

SEQ ID NO: 6280 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartg

SEQ ID NO: 6281 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (3)..(3): base is a locked nucleic acid
  modified_base (9)..(9): base is a locked nucleic acid
  modified_base (11)..(11): base is a locked nucleic acid
atcctgayaartg

SEQ ID NO: 6282 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (6)..(6): base is a locked nucleic acid
  modified_base (9)..(9): base is a locked nucleic acid
  modified_base (11)..(11): base is a locked nucleic acid
atcctgayaartg

SEQ ID NO: 6283 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (8)..(8): base is a locked nucleic acid
  modified_base (9)..(9): base is a locked nucleic acid
  modified_base (11)..(11): base is a locked nucleic acid
atcctgayaartg

SEQ ID NO: 6284 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (4)..(4): base is a locked nucleic acid
  modified_base (9)..(9): base is a locked nucleic acid
  modified_base (11)..(11): base is a locked nucleic acid
atcctgayaartg

SEQ ID NO: 6285 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
  modified_base (9)..(9): base is a locked nucleic acid
  modified_base (11)..(11): base is a locked nucleic acid
atcctgayaartg

SEQ ID NO: 6286 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
cctgataartggaca

SEQ ID NO: 6287 - DNA, 19 bp, Artificial Sequence
  Oligonucleotide probe
  misc_binding (1)..(19): Hybridization probe for the specific detection of wild-type HIV-1 at codon 238 of the reverse transcriptase gene.
atcctgayaartggacagt

SEQ ID NO: 6288 - DNA, 17 bp, Artificial Sequence
  Oligonucleotide probe
  misc_binding (1)..(17): Hybridization probe for the specific detection of wild-type HIV-1 at codon 238 of the reverse transcriptase gene.
atcctgayaartggaca

SEQ ID NO: 6289 - DNA, 18 bp, Artificial Sequence
  Oligonucleotide probe
  misc_binding (1)..(18): Hybridization probe for the specific detection of wild-type HIV-1 at codon 238 of the reverse transcriptase gene.
atcctgayaartggacag

SEQ ID NO: 6290 - DNA, 15 bp, Artificial Sequence
  Oligonucleotide probe
  misc_binding (1)..(15): Hybridization probe for the specific detection of wild-type HIV-1 at codon 238 of the reverse transcriptase gene.
atcctgayaartgga

SEQ ID NO: 6291 - DNA, 13 bp, Artificial Sequence
  Oligonucleotide probe
  misc_binding (1)..(13): Hybridization probe for the specific detection of wild-type HIV-1 at codon 238 of the reverse transcriptase gene.
atcctgayaartg

SEQ ID NO: 6292 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (12)..(12): base is a locked nucleic acid
tggrgyvtaatatgaycca

SEQ ID NO: 6293 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (19)..(19): base is a locked nucleic acid
tggrgyvtaatatgaycca

SEQ ID NO: 6294 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (14)..(14): base is a locked nucleic acid
tggrgyvtaatatgaycca

SEQ ID NO: 6295 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (17)..(17): base is a locked nucleic acid
tggrgyvtaatatgaycca

SEQ ID NO: 6296 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (4)..(4): base is a locked nucleic acid
tggrgyvtaatatgaycca

SEQ ID NO: 6297 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (3)..(3): base is a locked nucleic acid
tggrgyvtaatatgaycca

SEQ ID NO: 6298 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (5)..(5): base is a locked nucleic acid
tggrgyvtaatatgaycca

SEQ ID NO: 6299 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (7)..(7): base is a locked nucleic acid
tggrgyvtaatatgaycca

SEQ ID NO: 6300 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (9)..(9): base is a locked nucleic acid
  modified_base (11)..(11): base is a locked nucleic acid
  modified_base (15)..(15): base is a locked nucleic acid
tggrgyvtaatatgaycca

SEQ ID NO: 6301 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (9)..(9): base is a locked nucleic acid
  modified_base (11)..(11): base is a locked nucleic acid
  modified_base (17)..(17): base is a locked nucleic acid
tggrgyvtaatatgaycca

SEQ ID NO: 6302 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (9)..(9): base is a locked nucleic acid
  modified_base (11)..(11): base is a locked nucleic acid
  modified_base (14)..(14): base is a locked nucleic acid
tggrgyvtaatatgaycca

SEQ ID NO: 6303 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (9)..(9): base is a locked nucleic acid
  modified_base (11)..(11): base is a locked nucleic acid
  modified_base (12)..(12): base is a locked nucleic acid
tggrgyvtaatatgaycca

SEQ ID NO: 6304 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (8)..(8): base is a locked nucleic acid
  modified_base (9)..(9): base is a locked nucleic acid
  modified_base (11)..(11): base is a locked nucleic acid
tggrgyvtaatatgaycca

SEQ ID NO: 6305 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (3)..(3): base is a locked nucleic acid
  modified_base (9)..(9): base is a locked nucleic acid
  modified_base (11)..(11): base is a locked nucleic acid
tggrgyvtaatatgaycca

SEQ ID NO: 6306 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (7)..(7): base is a locked nucleic acid
  modified_base (9)..(9): base is a locked nucleic acid
  modified_base (11)..(11): base is a locked nucleic acid
tggrgyvtaatatgaycca

SEQ ID NO: 6307 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (6)..(6): base is a locked nucleic acid
  modified_base (9)..(9): base is a locked nucleic acid
  modified_base (11)..(11): base is a locked nucleic acid
tggrgyvtaatatgaycca

SEQ ID NO: 6308 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
  modified_base (9)..(9): base is a locked nucleic acid
  modified_base (11)..(11): base is a locked nucleic acid
tggrgyvtaatatgaycca

SEQ ID NO: 6309 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (11)..(11): base is a locked nucleic acid
ggrgyvtaatatgaycc

SEQ ID NO: 6310 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
ggrgyvtaatatgaycc

SEQ ID NO: 6311 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (13)..(13): base is a locked nucleic acid
ggrgyvtaatatgaycc

SEQ ID NO: 6312 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (16)..(16): base is a locked nucleic acid
ggrgyvtaatatgaycc

SEQ ID NO: 6313 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (3)..(3): base is a locked nucleic acid
ggrgyvtaatatgaycc

SEQ ID NO: 6314 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (2)..(2): base is a locked nucleic acid
ggrgyvtaatatgaycc

SEQ ID NO: 6315 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (4)..(4): base is a locked nucleic acid
ggrgyvtaatatgaycc

SEQ ID NO: 6316 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (6)..(6): base is a locked nucleic acid
ggrgyvtaatatgaycc

SEQ ID NO: 6317 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (14)..(14): base is a locked nucleic acid
ggrgyvtaatatgaycc

SEQ ID NO: 6318 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (16)..(16): base is a locked nucleic acid
ggrgyvtaatatgaycc

SEQ ID NO: 6319 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (13)..(13): base is a locked nucleic acid
ggrgyvtaatatgaycc

SEQ ID NO: 6320 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (11)..(11): base is a locked nucleic acid
ggrgyvtaatatgaycc

SEQ ID NO: 6321 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (7)..(7): base is a locked nucleic acid
  modified_base (8)..(8): base is a locked nucleic acid
  modified_base (10)..(10): base is a locked nucleic acid
ggrgyvtaatatgaycc

SEQ ID NO: 6322 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (2)..(2): base is a locked nucleic acid
  modified_base (8)..(8): base is a locked nucleic acid
  modified_base (10)..(10): base is a locked nucleic acid
ggrgyvtaatatgaycc

SEQ ID NO: 6323 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (6)..(6): base is a locked nucleic acid
  modified_base (8)..(8): base is a locked nucleic acid
  modified_base (10)..(10): base is a locked nucleic acid
ggrgyvtaatatgaycc

SEQ ID NO: 6324 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (5)..(5): base is a locked nucleic acid
  modified_base (8)..(8): base is a locked nucleic acid
  modified_base (10)..(10): base is a locked nucleic acid
ggrgyvtaatatgaycc

SEQ ID NO: 6325 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
ggrgyvtaatatgaycc

SEQ ID NO: 6326 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (11)..(11): base is a locked nucleic acid
ggrgyvtaatatgay

SEQ ID NO: 6327 - DNA, 16 bp, Artificial Sequence
  Oligonucleotide probe
  misc_binding (1)..(16): Hybridization probe for the specific detection of wild-type HIV-1 at codon 318 of the reverse transcriptase gene.
ggrgyvtaatatgayc

SEQ ID NO: 6328 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (13)..(13): base is a locked nucleic acid
ggrgyvtaatatgay

SEQ ID NO: 6329 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
ggrgyvtaatatgay

SEQ ID NO: 6330 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (3)..(3): base is a locked nucleic acid
ggrgyvtaatatgay

SEQ ID NO: 6331 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (2)..(2): base is a locked nucleic acid
ggrgyvtaatatgay

SEQ ID NO: 6332 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (4)..(4): base is a locked nucleic acid
ggrgyvtaatatgay

SEQ ID NO: 6333 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (6)..(6): base is a locked nucleic acid
ggrgyvtaatatgay

SEQ ID NO: 6334 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (14)..(14): base is a locked nucleic acid
ggrgyvtaatatgay

SEQ ID NO: 6335 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
ggrgyvtaatatgay

SEQ ID NO: 6336 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (13)..(13): base is a locked nucleic acid
ggrgyvtaatatgay

SEQ ID NO: 6337 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (11)..(11): base is a locked nucleic acid
ggrgyvtaatatgay

SEQ ID NO: 6338 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (7)..(7): base is a locked nucleic acid
  modified_base (8)..(8): base is a locked nucleic acid
  modified_base (10)..(10): base is a locked nucleic acid
ggrgyvtaatatgay

SEQ ID NO: 6339 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (2)..(2): base is a locked nucleic acid
  modified_base (8)..(8): base is a locked nucleic acid
  modified_base (10)..(10): base is a locked nucleic acid
ggrgyvtaatatgay

SEQ ID NO: 6340 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (6)..(6): base is a locked nucleic acid
  modified_base (8)..(8): base is a locked nucleic acid
  modified_base (10)..(10): base is a locked nucleic acid
ggrgyvtaatatgay

SEQ ID NO: 6341 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (5)..(5): base is a locked nucleic acid
  modified_base (8)..(8): base is a locked nucleic acid
  modified_base (10)..(10): base is a locked nucleic acid
ggrgyvtaatatgay

SEQ ID NO: 6342 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
ggrgyvtaatatgay

SEQ ID NO: 6343 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (11)..(11): base is a locked nucleic acid
ggrgyvtaatatg

SEQ ID NO: 6344 - DNA, 14 bp, Artificial Sequence
  Oligonucleotide probe
  misc_binding (1)..(14): Hybridization probe for the specific detection of wild-type HIV-1 at codon 318 of the reverse transcriptase gene.
ggrgyvtaatatga

SEQ ID NO: 6345 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (13)..(13): base is a locked nucleic acid
ggrgyvtaatatg

SEQ ID NO: 6346 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (3)..(3): base is a locked nucleic acid
ggrgyvtaatatg

SEQ ID NO: 6347 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (2)..(2): base is a locked nucleic acid
ggrgyvtaatatg

SEQ ID NO: 6348 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (4)..(4): base is a locked nucleic acid
ggrgyvtaatatg

SEQ ID NO: 6349 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (6)..(6): base is a locked nucleic acid
ggrgyvtaatatg

SEQ ID NO: 6350 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
ggrgyvtaatatg

SEQ ID NO: 6351 - DNA, 14 bp, Artificial Sequence
  Oligonucleotide probe
  misc_binding (1)..(14): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
ggrgyvtaatatga

SEQ ID NO: 6352 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (13)..(13): base is a locked nucleic acid
ggrgyvtaatatg

SEQ ID NO: 6353 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
  modified_base (11)..(11): base is a locked nucleic acid
ggrgyvtaatatg

SEQ ID NO: 6354 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (7)..(7): base is a locked nucleic acid
  modified_base (8)..(8): base is a locked nucleic acid
  modified_base (10)..(10): base is a locked nucleic acid
ggrgyvtaatatg

SEQ ID NO: 6355 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (2)..(2): base is a locked nucleic acid
  modified_base (8)..(8): base is a locked nucleic acid
  modified_base (10)..(10): base is a locked nucleic acid
ggrgyvtaatatg

SEQ ID NO: 6356 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (6)..(6): base is a locked nucleic acid
  modified_base (8)..(8): base is a locked nucleic acid
  modified_base (10)..(10): base is a locked nucleic acid
ggrgyvtaatatg

SEQ ID NO: 6357 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (5)..(5): base is a locked nucleic acid
  modified_base (8)..(8): base is a locked nucleic acid
  modified_base (10)..(10): base is a locked nucleic acid
ggrgyvtaatatg

SEQ ID NO: 6358 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
  modified_base (8)..(8): base is a locked nucleic acid
  modified_base (10)..(10): base is a locked nucleic acid
ggrgyvtaatatg

SEQ ID NO: 6359 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
tggagtayattatga

SEQ ID NO: 6360 - DNA, 19 bp, Artificial Sequence
  Oligonucleotide probe
  misc_binding (1)..(19): Hybridization probe for the specific detection of wild-type HIV-1 at codon 318 of the reverse transcriptase gene.
tggrgyvtaatatgaycca

SEQ ID NO: 6361 - DNA, 17 bp, Artificial Sequence
  Oligonucleotide probe
  misc_binding (1)..(17): Hybridization probe for the specific detection of wild-type HIV-1 at codon 318 of the reverse transcriptase gene.
ggrgyvtaatatgaycc

SEQ ID NO: 6362 - DNA, 15 bp, Artificial Sequence
  Oligonucleotide probe
  misc_binding (1)..(15): Hybridization probe for the specific detection of wild-type HIV-1 at codon 318 of the reverse transcriptase gene.
ggrgyvtaatatgay

SEQ ID NO: 6363 - DNA, 13 bp, Artificial Sequence
  Oligonucleotide probe
  misc_binding (1)..(13): Hybridization probe for the specific detection of wild-type HIV-1 at codon 318 of the reverse transcriptase gene.
ggrgyvtaatatg

SEQ ID NO: 6364 - DNA, 15 bp, Artificial Sequence
  Oligonucleotide probe
  misc_binding (1)..(15): Hybridization probe for the specific detection of mutant HIV-1 at codon 40 of the reverse transcriptase gene.
tgtacattyatggaa

SEQ ID NO: 6365 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (14)..(14): base is a locked nucleic acid
tgtrmdgadtggarrarg

SEQ ID NO: 6366 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (10)..(10): base is a locked nucleic acid
tgtrmdgadtggarrarg

SEQ ID NO: 6367 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (16)..(16): base is a locked nucleic acid
tgtrmdgadtggarrarg

SEQ ID NO: 6368 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (12)..(12): base is a locked nucleic acid
tgtrmdgadtggarrarg

SEQ ID NO: 6369 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (3)..(3): base is a locked nucleic acid
tgtrmdgadtggarrarg

SEQ ID NO: 6370 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (8)..(8): base is a locked nucleic acid
tgtrmdgadtggarrarg

SEQ ID NO: 6371 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (5)..(5): base is a locked nucleic acid
tgtrmdgadtggarrarg

SEQ ID NO: 6372 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (7)..(7): base is a locked nucleic acid
tgtrmdgadtggarrarg

SEQ ID NO: 6373 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (9)..(9): base is a locked nucleic acid
  modified_base (10)..(10): base is a locked nucleic acid
  modified_base (15)..(15): base is a locked nucleic acid
tgtrmdgadtggarrarg

SEQ ID NO: 6374 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (9)..(9): base is a locked nucleic acid
  modified_base (10)..(10): base is a locked nucleic acid
  modified_base (13)..(13): base is a locked nucleic acid
tgtrmdgadtggarrarg

SEQ ID NO: 6375 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (9)..(9): base is a locked nucleic acid
  modified_base (10)..(10): base is a locked nucleic acid
  modified_base (16)..(16): base is a locked nucleic acid
tgtrmdgadtggarrarg

SEQ ID NO: 6376 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (9)..(9): base is a locked nucleic acid
  modified_base (10)..(10): base is a locked nucleic acid
  modified_base (17)..(17): base is a locked nucleic acid
tgtrmdgadtggarrarg

SEQ ID NO: 6377 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (3)..(3): base is a locked nucleic acid
  modified_base (9)..(9): base is a locked nucleic acid
  modified_base (10)..(10): base is a locked nucleic acid
tgtrmdgadtggarrarg

SEQ ID NO: 6378 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (2)..(2): base is a locked nucleic acid
  modified_base (9)..(9): base is a locked nucleic acid
  modified_base (10)..(10): base is a locked nucleic acid
tgtrmdgadtggarrarg

SEQ ID NO: 6379 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (6)..(6): base is a locked nucleic acid
  modified_base (9)..(9): base is a locked nucleic acid
  modified_base (10)..(10): base is a locked nucleic acid
tgtrmdgadtggarrarg

SEQ ID NO: 6380 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (7)..(7): base is a locked nucleic acid
  modified_base (9)..(9): base is a locked nucleic acid
  modified_base (10)..(10): base is a locked nucleic acid
tgtrmdgadtggarrarg

SEQ ID NO: 6381 - DNA, 18 bp, Artificial Sequence
  Oligonucleotide probe
  misc_binding (1)..(18): Hybridization probe for the specific detection of mutant HIV-1 at codon 41 of the reverse transcriptase gene.
  modified_base (9)..(9): base is a locked nucleic acid
  modified_base (10)..(10): base is a locked nucleic acid
tgtrmdgadtggarrarg

SEQ ID NO: 6382 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (13)..(13): base is a locked nucleic acid
gtrmdgadtggarrarg

SEQ ID NO: 6383 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (9)..(9): base is a locked nucleic acid
gtrmdgadtggarrarg

SEQ ID NO: 6384 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (15)..(15): base is a locked nucleic acid
gtrmdgadtggarrarg

SEQ ID NO: 6385 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (11)..(11): base is a locked nucleic acid
gtrmdgadtggarrarg

SEQ ID NO: 6386 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (2)..(2): base is a locked nucleic acid
gtrmdgadtggarrarg

SEQ ID NO: 6387 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (7)..(7): base is a locked nucleic acid
gtrmdgadtggarrarg

SEQ ID NO: 6388 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (4)..(4): base is a locked nucleic acid
gtrmdgadtggarrarg

SEQ ID NO: 6389 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (6)..(6): base is a locked nucleic acid
gtrmdgadtggarrarg

SEQ ID NO: 6390 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (14)..(14): base is a locked nucleic acid
gtrmdgadtggarrarg

SEQ ID NO: 6391 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (12)..(12): base is a locked nucleic acid
gtrmdgadtggarrarg

SEQ ID NO: 6392 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (15)..(15): base is a locked nucleic acid
gtrmdgadtggarrarg

SEQ ID NO: 6393 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (16)..(16): base is a locked nucleic acid
gtrmdgadtggarrarg

SEQ ID NO: 6394 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (2)..(2): base is a locked nucleic acid
  modified_base (8)..(8): base is a locked nucleic acid
  modified_base (9)..(9): base is a locked nucleic acid
gtrmdgadtggarrarg

SEQ ID NO: 6395 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (1)..(1): base is a locked nucleic acid
  modified_base (8)..(8): base is a locked nucleic acid
  modified_base (9)..(9): base is a locked nucleic acid
gtrmdgadtggarrarg

SEQ ID NO: 6396 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (5)..(5): base is a locked nucleic acid
  modified_base (8)..(8): base is a locked nucleic acid
  modified_base (9)..(9): base is a locked nucleic acid
gtrmdgadtggarrarg

SEQ ID NO: 6397 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (6)..(6): base is a locked nucleic acid
  modified_base (8)..(8): base is a locked nucleic acid
  modified_base (9)..(9): base is a locked nucleic acid
gtrmdgadtggarrarg

SEQ ID NO: 6398 - DNA, 17 bp, Artificial Sequence
  Oligonucleotide probe
  misc_binding (1)..(17): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
gtrmdgadtggarrarg

SEQ ID NO: 6399 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (13)..(13): base is a locked nucleic acid
gtrmdgadtggarra

SEQ ID NO: 6400 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (9)..(9): base is a locked nucleic acid
gtrmdgadtggarra

SEQ ID NO: 6401 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (15)..(15): base is a locked nucleic acid
gtrmdgadtggarra

SEQ ID NO: 6402 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (11)..(11): base is a locked nucleic acid
gtrmdgadtggarra

SEQ ID NO: 6403 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (2)..(2): base is a locked nucleic acid
gtrmdgadtggarra

SEQ ID NO: 6404 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (7)..(7): base is a locked nucleic acid
gtrmdgadtggarra

SEQ ID NO: 6405 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (4)..(4): base is a locked nucleic acid
gtrmdgadtggarra

SEQ ID NO: 6406 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (6)..(6): base is a locked nucleic acid
gtrmdgadtggarra

SEQ ID NO: 6407 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (14)..(14): base is a locked nucleic acid
gtrmdgadtggarra

SEQ ID NO: 6408 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (12)..(12): base is a locked nucleic acid
gtrmdgadtggarra

SEQ ID NO: 6409 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (15)..(15): base is a locked nucleic acid
gtrmdgadtggarra

SEQ ID NO: 6410 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
gtrmdgadtggarra

SEQ ID NO: 6411 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (2)..(2): base is a locked nucleic acid
  modified_base (8)..(8): base is a locked nucleic acid
  modified_base (9)..(9): base is a locked nucleic acid
gtrmdgadtggarra

SEQ ID NO: 6412 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (1)..(1): base is a locked nucleic acid
  modified_base (8)..(8): base is a locked nucleic acid
  modified_base (9)..(9): base is a locked nucleic acid
gtrmdgadtggarra

SEQ ID NO: 6413 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (5)..(5): base is a locked nucleic acid
  modified_base (8)..(8): base is a locked nucleic acid
  modified_base (9)..(9): base is a locked nucleic acid
gtrmdgadtggarra

SEQ ID NO: 6414 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (6)..(6): base is a locked nucleic acid
  modified_base (8)..(8): base is a locked nucleic acid
  modified_base (9)..(9): base is a locked nucleic acid
gtrmdgadtggarra

SEQ ID NO: 6415 - DNA, 15 bp, Artificial Sequence
  Oligonucleotide probe
  misc_binding (1)..(15): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
gtrmdgadtggarra

SEQ ID NO: 6416 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (13)..(13): base is a locked nucleic acid
gtrmdgadtggar

SEQ ID NO: 6417 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (9)..(9): base is a locked nucleic acid
gtrmdgadtggar

SEQ ID NO: 6418 - DNA, 14 bp, Artificial Sequence
  Oligonucleotide probe
  misc_binding (1)..(14): Hybridization probe for the specific detection of mutant HIV-1 at codon 41 of the reverse transcriptase gene.
gtrmdgadtggarr

SEQ ID NO: 6419 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (11)..(11): base is a locked nucleic acid
gtrmdgadtggar

SEQ ID NO: 6420 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (2)..(2): base is a locked nucleic acid
gtrmdgadtggar

SEQ ID NO: 6421 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (7)..(7): base is a locked nucleic acid
gtrmdgadtggar

SEQ ID NO: 6422 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (4)..(4): base is a locked nucleic acid
gtrmdgadtggar

SEQ ID NO: 6423 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (6)..(6): base is a locked nucleic acid
gtrmdgadtggar

SEQ ID NO: 6424 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
gtrmdgadtggar

SEQ ID NO: 6425 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
  modified_base (12)..(12): base is a locked nucleic acid
gtrmdgadtggar

SEQ ID NO: 6426 - DNA, 14 bp, Artificial Sequence
  Oligonucleotide probe
  misc_binding (1)..(14): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
gtrmdgadtggarr

SEQ ID NO: 6427 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (2)..(2): base is a locked nucleic acid
  modified_base (8)..(8): base is a locked nucleic acid
  modified_base (9)..(9): base is a locked nucleic acid
gtrmdgadtggar

SEQ ID NO: 6428 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (1)..(1): base is a locked nucleic acid
  modified_base (8)..(8): base is a locked nucleic acid
  modified_base (9)..(9): base is a locked nucleic acid
gtrmdgadtggar

SEQ ID NO: 6429 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (5)..(5): base is a locked nucleic acid
  modified_base (8)..(8): base is a locked nucleic acid
  modified_base (9)..(9): base is a locked nucleic acid
gtrmdgadtggar

SEQ ID NO: 6430 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (6)..(6): base is a locked nucleic acid
  modified_base (8)..(8): base is a locked nucleic acid
  modified_base (9)..(9): base is a locked nucleic acid
gtrmdgadtggar

SEQ ID NO: 6431 - DNA, 13 bp, Artificial Sequence
  Oligonucleotide probe
  misc_binding (1)..(13): Hybridization probe for the specific detection of mutant HIV-1 at codon 41 of the reverse transcriptase gene.
  modified_base (8)..(8): base is a locked nucleic acid
  modified_base (9)..(9): base is a locked nucleic acid
gtrmdgadtggar

SEQ ID NO: 6432 - DNA, 15 bp, Artificial Sequence
  Oligonucleotide probe
  misc_binding (1)..(15): Hybridization probe for the specific detection of mutant HIV-1 at codon 41 of the reverse transcriptase gene.
tacagayttggaaaa

SEQ ID NO: 6433 - DNA, 18 bp, Artificial Sequence
  Oligonucleotide probe
  misc_binding (1)..(18): Hybridization probe for the specific detection of mutant HIV-1 at codon 41 of the reverse transcriptase gene.
tgtrmdgadtggarrarg

SEQ ID NO: 6434 - DNA, 17 bp, Artificial Sequence
  Oligonucleotide probe
  misc_binding (1)..(17): Hybridization probe for the specific detection of mutant HIV-1 at codon 41 of the reverse transcriptase gene.
gtrmdgadtggarrarg

SEQ ID NO: 6435 - DNA, 15 bp, Artificial Sequence
  Oligonucleotide probe
  misc_binding (1)..(15): Hybridization probe for the specific detection of mutant HIV-1 at codon 41 of the reverse transcriptase gene.
gtrmdgadtggarra

SEQ ID NO: 6436 - DNA, 13 bp, Artificial Sequence
  Oligonucleotide probe
  misc_binding (1)..(13): Hybridization probe for the specific detection of mutant HIV-1 at codon 41 of the reverse transcriptase gene.
gtrmdgadtggar

SEQ ID NO: 6437 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (13)..(13): base is a locked nucleic acid
ggarrargaggraaaaty

SEQ ID NO: 6438 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (14)..(14): base is a locked nucleic acid
tggarrargaggraaaat

SEQ ID NO: 6439 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (10)..(10): base is a locked nucleic acid
ggarrargaggraaaaty

SEQ ID NO: 6440 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (10)..(10): base is a locked nucleic acid
tggarrargaggraaaat

SEQ ID NO: 6441 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (16)..(16): base is a locked nucleic acid
ggarrargaggraaaaty

SEQ ID NO: 6442 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (16)..(16): base is a locked nucleic acid
tggarrargaggraaaat

SEQ ID NO: 6443 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (14)..(14): base is a locked nucleic acid
ggarrargaggraaaaty

SEQ ID NO: 6444 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (12)..(12): base is a locked nucleic acid
tggarrargaggraaaat

SEQ ID NO: 6445 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (3)..(3): base is a locked nucleic acid
ggarrargaggraaaaty

SEQ ID NO: 6446 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (3)..(3): base is a locked nucleic acid
tggarrargaggraaaat

SEQ ID NO: 6447 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (7)..(7): base is a locked nucleic acid
ggarrargaggraaaaty

SEQ ID NO: 6448 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (8)..(8): base is a locked nucleic acid
tggarrargaggraaaat

SEQ ID NO: 6449 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (2)..(2): base is a locked nucleic acid
ggarrargaggraaaaty

SEQ ID NO: 6450 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (5)..(5): base is a locked nucleic acid
tggarrargaggraaaat

SEQ ID NO: 6451 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (8)..(8): base is a locked nucleic acid
ggarrargaggraaaaty

SEQ ID NO: 6452 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (7)..(7): base is a locked nucleic acid
tggarrargaggraaaat

SEQ ID NO: 6453 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (16)..(16): base is a locked nucleic acid
ggarrargaggraaaaty

SEQ ID NO: 6454 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (15)..(15): base is a locked nucleic acid
tggarrargaggraaaat

SEQ ID NO: 6455 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (15)..(15): base is a locked nucleic acid
ggarrargaggraaaaty

SEQ ID NO: 6456 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (13)..(13): base is a locked nucleic acid
tggarrargaggraaaat

SEQ ID NO: 6457 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (12)..(12): base is a locked nucleic acid
ggarrargaggraaaaty

SEQ ID NO: 6458 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (16)..(16): base is a locked nucleic acid
tggarrargaggraaaat

SEQ ID NO: 6459 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (13)..(13): base is a locked nucleic acid
ggarrargaggraaaaty

SEQ ID NO: 6460 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
  modified_base (17)..(17): base is a locked nucleic acid
tggarrargaggraaaat

SEQ ID NO: 6461 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (4)..(4): base is a locked nucleic acid
  modified_base (9)..(9): base is a locked nucleic acid
  modified_base (10)..(10): base is a locked nucleic acid
ggarrargaggraaaaty

SEQ ID NO: 6462 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (3)..(3): base is a locked nucleic acid
  modified_base (9)..(9): base is a locked nucleic acid
  modified_base (10)..(10): base is a locked nucleic acid
tggarrargaggraaaat

SEQ ID NO: 6463 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (10)..(10): base is a locked nucleic acid
ggarrargaggraaaaty

SEQ ID NO: 6464 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (2)..(2): base is a locked nucleic acid
  modified_base (9)..(9): base is a locked nucleic acid
  modified_base (10)..(10): base is a locked nucleic acid
tggarrargaggraaaat

SEQ ID NO: 6465 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (3)..(3): base is a locked nucleic acid
  modified_base (9)..(9): base is a locked nucleic acid
  modified_base (10)..(10): base is a locked nucleic acid
ggarrargaggraaaaty

SEQ ID NO: 6466 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (6)..(6): base is a locked nucleic acid
  modified_base (9)..(9): base is a locked nucleic acid
  modified_base (10)..(10): base is a locked nucleic acid
tggarrargaggraaaat

SEQ ID NO: 6467 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (5)..(5): base is a locked nucleic acid
  modified_base (9)..(9): base is a locked nucleic acid
  modified_base (10)..(10): base is a locked nucleic acid
ggarrargaggraaaaty

SEQ ID NO: 6468 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (7)..(7): base is a locked nucleic acid
  modified_base (9)..(9): base is a locked nucleic acid
  modified_base (10)..(10): base is a locked nucleic acid
tggarrargaggraaaat

SEQ ID NO: 6469 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
ggarrargaggraaaaty

SEQ ID NO: 6470 - DNA, 18 bp, Artificial Sequence
  Oligonucleotide probe
  misc_binding (1)..(18): Hybridization probe for the specific detection of mutant HIV-1 at codon 44 of the reverse transcriptase gene.
  modified_base (9)..(9): base is a locked nucleic acid
  modified_base (10)..(10): base is a locked nucleic acid
tggarrargaggraaaat

SEQ ID NO: 6471 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (12)..(12): base is a locked nucleic acid
garrargaggraaaaty

SEQ ID NO: 6472 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (13)..(13): base is a locked nucleic acid
ggarrargaggraaaat

SEQ ID NO: 6473 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (9)..(9): base is a locked nucleic acid
garrargaggraaaaty

SEQ ID NO: 6474 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (9)..(9): base is a locked nucleic acid
ggarrargaggraaaat

SEQ ID NO: 6475 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (15)..(15): base is a locked nucleic acid
garrargaggraaaaty

SEQ ID NO: 6476 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (15)..(15): base is a locked nucleic acid
ggarrargaggraaaat

SEQ ID NO: 6477 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (13)..(13): base is a locked nucleic acid
garrargaggraaaaty

SEQ ID NO: 6478 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (11)..(11): base is a locked nucleic acid
ggarrargaggraaaat

SEQ ID NO: 6479 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (2)..(2): base is a locked nucleic acid
garrargaggraaaaty

SEQ ID NO: 6480 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (2)..(2): base is a locked nucleic acid
ggarrargaggraaaat

SEQ ID NO: 6481 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (6)..(6): base is a locked nucleic acid
garrargaggraaaaty

SEQ ID NO: 6482 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (7)..(7): base is a locked nucleic acid
ggarrargaggraaaat

SEQ ID NO: 6483 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (1)..(1): base is a locked nucleic acid
garrargaggraaaaty

SEQ ID NO: 6484 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (4)..(4): base is a locked nucleic acid
ggarrargaggraaaat

SEQ ID NO: 6485 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (7)..(7): base is a locked nucleic acid
garrargaggraaaaty

SEQ ID NO: 6486 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (6)..(6): base is a locked nucleic acid
ggarrargaggraaaat

SEQ ID NO: 6487 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (15)..(15): base is a locked nucleic acid
garrargaggraaaaty

SEQ ID NO: 6488 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (14)..(14): base is a locked nucleic acid
ggarrargaggraaaat

SEQ ID NO: 6489 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (14)..(14): base is a locked nucleic acid
garrargaggraaaaty

SEQ ID NO: 6490 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (12)..(12): base is a locked nucleic acid
ggarrargaggraaaat

SEQ ID NO: 6491 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (11)..(11): base is a locked nucleic acid
garrargaggraaaaty

SEQ ID NO: 6492 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (15)..(15): base is a locked nucleic acid
ggarrargaggraaaat

SEQ ID NO: 6493 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (12)..(12): base is a locked nucleic acid
garrargaggraaaaty

SEQ ID NO: 6494 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (16)..(16): base is a locked nucleic acid
ggarrargaggraaaat

SEQ ID NO: 6495 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (3)..(3): base is a locked nucleic acid
  modified_base (8)..(8): base is a locked nucleic acid
  modified_base (9)..(9): base is a locked nucleic acid
garrargaggraaaaty

SEQ ID NO: 6496 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (2)..(2): base is a locked nucleic acid
  modified_base (8)..(8): base is a locked nucleic acid
  modified_base (9)..(9): base is a locked nucleic acid
ggarrargaggraaaat

SEQ ID NO: 6497 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (7)..(7): base is a locked nucleic acid
  modified_base (8)..(8): base is a locked nucleic acid
  modified_base (9)..(9): base is a locked nucleic acid
garrargaggraaaaty

SEQ ID NO: 6498 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (1)..(1): base is a locked nucleic acid
  modified_base (8)..(8): base is a locked nucleic acid
  modified_base (9)..(9): base is a locked nucleic acid
ggarrargaggraaaat

SEQ ID NO: 6499 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (2)..(2): base is a locked nucleic acid
  modified_base (8)..(8): base is a locked nucleic acid
  modified_base (9)..(9): base is a locked nucleic acid
garrargaggraaaaty

SEQ ID NO: 6500 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (5)..(5): base is a locked nucleic acid
  modified_base (8)..(8): base is a locked nucleic acid
  modified_base (9)..(9): base is a locked nucleic acid
ggarrargaggraaaat

SEQ ID NO: 6501 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (4)..(4): base is a locked nucleic acid
  modified_base (8)..(8): base is a locked nucleic acid
  modified_base (9)..(9): base is a locked nucleic acid
garrargaggraaaaty

SEQ ID NO: 6502 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (6)..(6): base is a locked nucleic acid
  modified_base (8)..(8): base is a locked nucleic acid
  modified_base (9)..(9): base is a locked nucleic acid
ggarrargaggraaaat

SEQ ID NO: 6503 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
garrargaggraaaaty

SEQ ID NO: 6504 - DNA, 17 bp, Artificial Sequence
  Oligonucleotide probe
  misc_binding (1)..(17): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
ggarrargaggraaaat

SEQ ID NO: 6505 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (12)..(12): base is a locked nucleic acid
garrargaggraaaa

SEQ ID NO: 6506 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (13)..(13): base is a locked nucleic acid
ggarrargaggraaa

SEQ ID NO: 6507 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (9)..(9): base is a locked nucleic acid
garrargaggraaaa

SEQ ID NO: 6508 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (9)..(9): base is a locked nucleic acid
ggarrargaggraaa

SEQ ID NO: 6509 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (15)..(15): base is a locked nucleic acid
garrargaggraaaa

SEQ ID NO: 6510 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (15)..(15): base is a locked nucleic acid
ggarrargaggraaa

SEQ ID NO: 6511 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (13)..(13): base is a locked nucleic acid
garrargaggraaaa

SEQ ID NO: 6512 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (11)..(11): base is a locked nucleic acid
ggarrargaggraaa

SEQ ID NO: 6513 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (2)..(2): base is a locked nucleic acid
garrargaggraaaa

SEQ ID NO: 6514 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (2)..(2): base is a locked nucleic acid
ggarrargaggraaa

SEQ ID NO: 6515 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (6)..(6): base is a locked nucleic acid
garrargaggraaaa

SEQ ID NO: 6516 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (7)..(7): base is a locked nucleic acid
ggarrargaggraaa

SEQ ID NO: 6517 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (1)..(1): base is a locked nucleic acid
garrargaggraaaa

SEQ ID NO: 6518 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (4)..(4): base is a locked nucleic acid
ggarrargaggraaa

SEQ ID NO: 6519 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (7)..(7): base is a locked nucleic acid
garrargaggraaaa

SEQ ID NO: 6520 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (6)..(6): base is a locked nucleic acid
ggarrargaggraaa

SEQ ID NO: 6521 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (15)..(15): base is a locked nucleic acid
garrargaggraaaa

SEQ ID NO: 6522 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (14)..(14): base is a locked nucleic acid
ggarrargaggraaa

SEQ ID NO: 6523 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (14)..(14): base is a locked nucleic acid
garrargaggraaaa

SEQ ID NO: 6524 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (12)..(12): base is a locked nucleic acid
ggarrargaggraaa

SEQ ID NO: 6525 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (11)..(11): base is a locked nucleic acid
garrargaggraaaa

SEQ ID NO: 6526 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (15)..(15): base is a locked nucleic acid
ggarrargaggraaa

SEQ ID NO: 6527 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (12)..(12): base is a locked nucleic acid
garrargaggraaaa

SEQ ID NO: 6528 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
ggarrargaggraaa

SEQ ID NO: 6529 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (3)..(3): base is a locked nucleic acid
  modified_base (8)..(8): base is a locked nucleic acid
  modified_base (9)..(9): base is a locked nucleic acid
garrargaggraaaa

SEQ ID NO: 6530 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (2)..(2): base is a locked nucleic acid
  modified_base (8)..(8): base is a locked nucleic acid
  modified_base (9)..(9): base is a locked nucleic acid
ggarrargaggraaa

SEQ ID NO: 6531 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (7)..(7): base is a locked nucleic acid
  modified_base (8)..(8): base is a locked nucleic acid
  modified_base (9)..(9): base is a locked nucleic acid
garrargaggraaaa

SEQ ID NO: 6532 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (1)..(1): base is a locked nucleic acid
  modified_base (8)..(8): base is a locked nucleic acid
  modified_base (9)..(9): base is a locked nucleic acid
ggarrargaggraaa

SEQ ID NO: 6533 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (2)..(2): base is a locked nucleic acid
  modified_base (8)..(8): base is a locked nucleic acid
  modified_base (9)..(9): base is a locked nucleic acid
garrargaggraaaa

SEQ ID NO: 6534 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (5)..(5): base is a locked nucleic acid
  modified_base (8)..(8): base is a locked nucleic acid
  modified_base (9)..(9): base is a locked nucleic acid
ggarrargaggraaa

SEQ ID NO: 6535 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (4)..(4): base is a locked nucleic acid
  modified_base (8)..(8): base is a locked nucleic acid
  modified_base (9)..(9): base is a locked nucleic acid
garrargaggraaaa

SEQ ID NO: 6536 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (6)..(6): base is a locked nucleic acid
  modified_base (8)..(8): base is a locked nucleic acid
  modified_base (9)..(9): base is a locked nucleic acid
ggarrargaggraaa

SEQ ID NO: 6537 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
garrargaggraaaa

SEQ ID NO: 6538 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
ggarrargaggraaa

SEQ ID NO: 6539 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (12)..(12): base is a locked nucleic acid
garrargaggraa

SEQ ID NO: 6540 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (13)..(13): base is a locked nucleic acid
ggarrargaggra

SEQ ID NO: 6541 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (9)..(9): base is a locked nucleic acid
garrargaggraa

SEQ ID NO: 6542 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (9)..(9): base is a locked nucleic acid
ggarrargaggra

SEQ ID NO: 6543 - DNA, 14 bp, Artificial Sequence
  Oligonucleotide probe
  misc_binding (1)..(14): Hybridization probe for the specific detection of mutant HIV-1 at codon 44 of the reverse transcriptase gene.
garrargaggraaa

SEQ ID NO: 6544 - DNA, 14 bp, Artificial Sequence
  Oligonucleotide probe
  misc_binding (1)..(14): Hybridization probe for the specific detection of mutant HIV-1 at codon 44 of the reverse transcriptase gene.
ggarrargaggraa

SEQ ID NO: 6545 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (13)..(13): base is a locked nucleic acid
garrargaggraa

SEQ ID NO: 6546 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (11)..(11): base is a locked nucleic acid
ggarrargaggra

SEQ ID NO: 6547 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (2)..(2): base is a locked nucleic acid
garrargaggraa

SEQ ID NO: 6548 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (2)..(2): base is a locked nucleic acid
ggarrargaggra

SEQ ID NO: 6549 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (6)..(6): base is a locked nucleic acid
garrargaggraa

SEQ ID NO: 6550 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (7)..(7): base is a locked nucleic acid
ggarrargaggra

SEQ ID NO: 6551 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (1)..(1): base is a locked nucleic acid
garrargaggraa

SEQ ID NO: 6552 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (4)..(4): base is a locked nucleic acid
ggarrargaggra

SEQ ID NO: 6553 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (7)..(7): base is a locked nucleic acid
garrargaggraa

SEQ ID NO: 6554 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (6)..(6): base is a locked nucleic acid
ggarrargaggra

SEQ ID NO: 6555 - DNA, 14 bp, Artificial Sequence
  Oligonucleotide probe
  misc_binding (1)..(14): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
garrargaggraaa

SEQ ID NO: 6556 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
ggarrargaggra

SEQ ID NO: 6557 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
garrargaggraa

SEQ ID NO: 6558 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (12)..(12): base is a locked nucleic acid
ggarrargaggra

SEQ ID NO: 6559 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (11)..(11): base is a locked nucleic acid
garrargaggraa

SEQ ID NO: 6560 - DNA, 14 bp, Artificial Sequence
  Oligonucleotide probe
  misc_binding (1)..(14): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
ggarrargaggraa

SEQ ID NO: 6561 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
  modified_base (12)..(12): base is a locked nucleic acid
garrargaggraa

SEQ ID NO: 6562 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (3)..(3): base is a locked nucleic acid
  modified_base (8)..(8): base is a locked nucleic acid
  modified_base (9)..(9): base is a locked nucleic acid
garrargaggraa

SEQ ID NO: 6563 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (2)..(2): base is a locked nucleic acid
  modified_base (8)..(8): base is a locked nucleic acid
  modified_base (9)..(9): base is a locked nucleic acid
ggarrargaggra

SEQ ID NO: 6564 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (7)..(7): base is a locked nucleic acid
  modified_base (8)..(8): base is a locked nucleic acid
  modified_base (9)..(9): base is a locked nucleic acid
garrargaggraa

SEQ ID NO: 6565 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (1)..(1): base is a locked nucleic acid
  modified_base (8)..(8): base is a locked nucleic acid
  modified_base (9)..(9): base is a locked nucleic acid
ggarrargaggra

SEQ ID NO: 6566 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (2)..(2): base is a locked nucleic acid
  modified_base (8)..(8): base is a locked nucleic acid
  modified_base (9)..(9): base is a locked nucleic acid
garrargaggraa

SEQ ID NO: 6567 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (5)..(5): base is a locked nucleic acid
  modified_base (8)..(8): base is a locked nucleic acid
  modified_base (9)..(9): base is a locked nucleic acid
ggarrargaggra

SEQ ID NO: 6568 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (4)..(4): base is a locked nucleic acid
  modified_base (8)..(8): base is a locked nucleic acid
  modified_base (9)..(9): base is a locked nucleic acid
garrargaggraa

SEQ ID NO: 6569 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (6)..(6): base is a locked nucleic acid
  modified_base (8)..(8): base is a locked nucleic acid
  modified_base (9)..(9): base is a locked nucleic acid
ggarrargaggra

SEQ ID NO: 6570 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
garrargaggraa

SEQ ID NO: 6571 - DNA, 13 bp, Artificial Sequence
  Oligonucleotide probe
  misc_binding (1)..(13): Hybridization probe for the specific detection of mutant HIV-1 at codon 44 of the reverse transcriptase gene.
  modified_base (8)..(8): base is a locked nucleic acid
  modified_base (9)..(9): base is a locked nucleic acid
ggarrargaggra

SEQ ID NO: 6572 - DNA, 15 bp, Artificial Sequence
  Oligonucleotide probe
  misc_binding (1)..(15): Hybridization probe for the specific detection of mutant HIV-1 at codon 44 of the reverse transcriptase gene.
aaaaggayggaaaaa

SEQ ID NO: 6573 - DNA, 15 bp, Artificial Sequence
  Oligonucleotide probe
  misc_binding (1)..(15): Hybridization probe for the specific detection of mutant HIV-1 at codon 44 of the reverse transcriptase gene.
  misc_feature (8)..(8): n is a, c, g, or t
aaaaggcnggaaaaa

SEQ ID NO: 6574 - DNA, 18 bp, Artificial Sequence
  Oligonucleotide probe
  misc_binding (1)..(18): Hybridization probe for the specific detection of mutant HIV-1 at codon 44 of the reverse transcriptase gene.
ggarrargaggraaaaty

SEQ ID NO: 6575 - DNA, 18 bp, Artificial Sequence
  Oligonucleotide probe
  misc_binding (1)..(18): Hybridization probe for the specific detection of mutant HIV-1 at codon 44 of the reverse transcriptase gene.
tggarrargaggraaaat

SEQ ID NO: 6576 - DNA, 17 bp, Artificial Sequence
  Oligonucleotide probe
  misc_binding (1)..(17): Hybridization probe for the specific detection of mutant HIV-1 at codon 44 of the reverse transcriptase gene.
garrargaggraaaaty

SEQ ID NO: 6577 - DNA, 17 bp, Artificial Sequence
  Oligonucleotide probe
  misc_binding (1)..(17): Hybridization probe for the specific detection of mutant HIV-1 at codon 44 of the reverse transcriptase gene.
ggarrargaggraaaat

SEQ ID NO: 6578 - DNA, 15 bp, Artificial Sequence
  Oligonucleotide probe
  misc_binding (1)..(15): Hybridization probe for the specific detection of mutant HIV-1 at codon 44 of the reverse transcriptase gene.
garrargaggraaaa

SEQ ID NO: 6579 - DNA, 15 bp, Artificial Sequence
  Oligonucleotide probe
  misc_binding (1)..(15): Hybridization probe for the specific detection of mutant HIV-1 at codon 44 of the reverse transcriptase gene.
ggarrargaggraaa

SEQ ID NO: 6580 - DNA, 13 bp, Artificial Sequence
  Oligonucleotide probe
  misc_binding (1)..(13): Hybridization probe for the specific detection of mutant HIV-1 at codon 44 of the reverse transcriptase gene.
garrargaggraa

SEQ ID NO: 6581 - DNA, 13 bp, Artificial Sequence
  Oligonucleotide probe
  misc_binding (1)..(13): Hybridization probe for the specific detection of mutant HIV-1 at codon 44 of the reverse transcriptase gene.
ggarrargaggra

SEQ ID NO: 6582 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (13)..(13): base is a locked nucleic acid
cartatttgyataaaraa

SEQ ID NO: 6583 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (11)..(11): base is a locked nucleic acid
cartatttgyataaaraa

SEQ ID NO: 6584 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (17)..(17): base is a locked nucleic acid
cartatttgyataaaraa

SEQ ID NO: 6585 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (16)..(16): base is a locked nucleic acid
cartatttgyataaaraa

SEQ ID NO: 6586 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (3)..(3): base is a locked nucleic acid
cartatttgyataaaraa

SEQ ID NO: 6587 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (7)..(7): base is a locked nucleic acid
cartatttgyataaaraa

SEQ ID NO: 6588 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (8)..(8): base is a locked nucleic acid
cartatttgyataaaraa

SEQ ID NO: 6589 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (6)..(6): base is a locked nucleic acid
cartatttgyataaaraa

SEQ ID NO: 6590 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (9)..(9): base is a locked nucleic acid
  modified_base (10)..(10): base is a locked nucleic acid
  modified_base (14)..(14): base is a locked nucleic acid
cartatttgyataaaraa

SEQ ID NO: 6591 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (9)..(9): base is a locked nucleic acid
  modified_base (10)..(10): base is a locked nucleic acid
  modified_base (17)..(17): base is a locked nucleic acid
cartatttgyataaaraa

SEQ ID NO: 6592 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (9)..(9): base is a locked nucleic acid
  modified_base (10)..(10): base is a locked nucleic acid
  modified_base (11)..(11): base is a locked nucleic acid
cartatttgyataaaraa

SEQ ID NO: 6593 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (9)..(9): base is a locked nucleic acid
  modified_base (10)..(10): base is a locked nucleic acid
  modified_base (15)..(15): base is a locked nucleic acid
cartatttgyataaaraa

SEQ ID NO: 6594 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (10)..(10): base is a locked nucleic acid
cartatttgyataaaraa

SEQ ID NO: 6595 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (5)..(5): base is a locked nucleic acid
  modified_base (9)..(9): base is a locked nucleic acid
  modified_base (10)..(10): base is a locked nucleic acid
cartatttgyataaaraa

SEQ ID NO: 6596 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (7)..(7): base is a locked nucleic acid
  modified_base (9)..(9): base is a locked nucleic acid
  modified_base (10)..(10): base is a locked nucleic acid
cartatttgyataaaraa

SEQ ID NO: 6597 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (2)..(2): base is a locked nucleic acid
  modified_base (9)..(9): base is a locked nucleic acid
  modified_base (10)..(10): base is a locked nucleic acid
cartatttgyataaaraa

SEQ ID NO: 6598 - DNA, 18 bp, Artificial Sequence
  Oligonucleotide probe
  misc_binding (1)..(18): Hybridization probe for the specific detection of mutant HIV-1 at codon 62 of the reverse transcriptase gene.
  modified_base (9)..(9): base is a locked nucleic acid
  modified_base (10)..(10): base is a locked nucleic acid
cartatttgyataaaraa

SEQ ID NO: 6599 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (12)..(12): base is a locked nucleic acid
artatttgyataaaraa

SEQ ID NO: 6600 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (10)..(10): base is a locked nucleic acid
artatttgyataaaraa

SEQ ID NO: 6601 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (16)..(16): base is a locked nucleic acid
artatttgyataaaraa

SEQ ID NO: 6602 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (15)..(15): base is a locked nucleic acid
artatttgyataaaraa

SEQ ID NO: 6603 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (2)..(2): base is a locked nucleic acid
artatttgyataaaraa

SEQ ID NO: 6604 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (6)..(6): base is a locked nucleic acid
artatttgyataaaraa

SEQ ID NO: 6605 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (7)..(7): base is a locked nucleic acid
artatttgyataaaraa

SEQ ID NO: 6606 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (5)..(5): base is a locked nucleic acid
artatttgyataaaraa

SEQ ID NO: 6607 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (13)..(13): base is a locked nucleic acid
artatttgyataaaraa

SEQ ID NO: 6608 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (16)..(16): base is a locked nucleic acid
artatttgyataaaraa

SEQ ID NO: 6609 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (10)..(10): base is a locked nucleic acid
artatttgyataaaraa

SEQ ID NO: 6610 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (14)..(14): base is a locked nucleic acid
artatttgyataaaraa

SEQ ID NO: 6611 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (7)..(7): base is a locked nucleic acid
  modified_base (8)..(8): base is a locked nucleic acid
  modified_base (9)..(9): base is a locked nucleic acid
artatttgyataaaraa

SEQ ID NO: 6612 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (4)..(4): base is a locked nucleic acid
  modified_base (8)..(8): base is a locked nucleic acid
  modified_base (9)..(9): base is a locked nucleic acid
artatttgyataaaraa

SEQ ID NO: 6613 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (6)..(6): base is a locked nucleic acid
  modified_base (8)..(8): base is a locked nucleic acid
  modified_base (9)..(9): base is a locked nucleic acid
artatttgyataaaraa

SEQ ID NO: 6614 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (1)..(1): base is a locked nucleic acid
  modified_base (8)..(8): base is a locked nucleic acid
  modified_base (9)..(9): base is a locked nucleic acid
artatttgyataaaraa

SEQ ID NO: 6615 - DNA, 17 bp, Artificial Sequence
  Oligonucleotide probe
  misc_binding (1)..(17): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
artatttgyataaaraa

SEQ ID NO: 6616 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (12)..(12): base is a locked nucleic acid
artatttgyataaar

SEQ ID NO: 6617 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (10)..(10): base is a locked nucleic acid
artatttgyataaar

SEQ ID NO: 6618 - DNA, 15 bp, Artificial Sequence
  Oligonucleotide probe
  misc_binding (1)..(15): Hybridization probe for the specific detection of mutant HIV-1 at codon 62 of the reverse transcriptase gene.
artatttgyataaar

SEQ ID NO: 6619 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (15)..(15): base is a locked nucleic acid
artatttgyataaar

SEQ ID NO: 6620 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (2)..(2): base is a locked nucleic acid
artatttgyataaar

SEQ ID NO: 6621 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (6)..(6): base is a locked nucleic acid
artatttgyataaar

SEQ ID NO: 6622 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (7)..(7): base is a locked nucleic acid
artatttgyataaar

SEQ ID NO: 6623 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (5)..(5): base is a locked nucleic acid
artatttgyataaar

SEQ ID NO: 6624 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (13)..(13): base is a locked nucleic acid
artatttgyataaar

SEQ ID NO: 6625 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
artatttgyataaar

SEQ ID NO: 6626 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (10)..(10): base is a locked nucleic acid
artatttgyataaar

SEQ ID NO: 6627 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (14)..(14): base is a locked nucleic acid
artatttgyataaar

SEQ ID NO: 6628 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (7)..(7): base is a locked nucleic acid
  modified_base (8)..(8): base is a locked nucleic acid
  modified_base (9)..(9): base is a locked nucleic acid
artatttgyataaar

SEQ ID NO: 6629 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (4)..(4): base is a locked nucleic acid
  modified_base (8)..(8): base is a locked nucleic acid
  modified_base (9)..(9): base is a locked nucleic acid
artatttgyataaar

SEQ ID NO: 6630 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (6)..(6): base is a locked nucleic acid
  modified_base (8)..(8): base is a locked nucleic acid
  modified_base (9)..(9): base is a locked nucleic acid
artatttgyataaar

SEQ ID NO: 6631 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (1)..(1): base is a locked nucleic acid
  modified_base (8)..(8): base is a locked nucleic acid
  modified_base (9)..(9): base is a locked nucleic acid
artatttgyataaar

SEQ ID NO: 6632 - DNA, 15 bp, Artificial Sequence
  Oligonucleotide probe
  misc_binding (1)..(15): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
artatttgyataaar

SEQ ID NO: 6633 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (12)..(12): base is a locked nucleic acid
artatttgyataa

SEQ ID NO: 6634 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (10)..(10): base is a locked nucleic acid
artatttgyataa

SEQ ID NO: 6635 - DNA, 14 bp, Artificial Sequence
  Oligonucleotide probe
  misc_binding (1)..(14): Hybridization probe for the specific detection of mutant HIV-1 at codon 62 of the reverse transcriptase gene.
artatttgyataaa

SEQ ID NO: 6636 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (2)..(2): base is a locked nucleic acid
artatttgyataa

SEQ ID NO: 6637 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (6)..(6): base is a locked nucleic acid
artatttgyataa

SEQ ID NO: 6638 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (7)..(7): base is a locked nucleic acid
artatttgyataa

SEQ ID NO: 6639 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (5)..(5): base is a locked nucleic acid
artatttgyataa

SEQ ID NO: 6640 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (13)..(13): base is a locked nucleic acid
artatttgyataa

SEQ ID NO: 6641 - DNA, 14 bp, Artificial Sequence
  Oligonucleotide probe
  misc_binding (1)..(14): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
artatttgyataaa

SEQ ID NO: 6642 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
  modified_base (10)..(10): base is a locked nucleic acid
artatttgyataa

SEQ ID NO: 6643 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
artatttgyataa

SEQ ID NO: 6644 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (7)..(7): base is a locked nucleic acid
  modified_base (8)..(8): base is a locked nucleic acid
  modified_base (9)..(9): base is a locked nucleic acid
artatttgyataa

SEQ ID NO: 6645 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (4)..(4): base is a locked nucleic acid
  modified_base (8)..(8): base is a locked nucleic acid
  modified_base (9)..(9): base is a locked nucleic acid
artatttgyataa

SEQ ID NO: 6646 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (6)..(6): base is a locked nucleic acid
  modified_base (8)..(8): base is a locked nucleic acid
  modified_base (9)..(9): base is a locked nucleic acid
artatttgyataa

SEQ ID NO: 6647 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (1)..(1): base is a locked nucleic acid
  modified_base (8)..(8): base is a locked nucleic acid
  modified_base (9)..(9): base is a locked nucleic acid
artatttgyataa

SEQ ID NO: 6648 - DNA, 13 bp, Artificial Sequence
  Oligonucleotide probe
  misc_binding (1)..(13): Hybridization probe for the specific detection of mutant HIV-1 at codon 62 of the reverse transcriptase gene.
  modified_base (8)..(8): base is a locked nucleic acid
  modified_base (9)..(9): base is a locked nucleic acid
artatttgyataa

SEQ ID NO: 6649 - DNA, 15 bp, Artificial Sequence
  Oligonucleotide probe
  misc_binding (1)..(15): Hybridization probe for the specific detection of mutant HIV-1 at codon 62 of the reverse transcriptase gene.
ctttatdtcaaatac

SEQ ID NO: 6650 - DNA, 18 bp, Artificial Sequence
  Oligonucleotide probe
  misc_binding (1)..(18): Hybridization probe for the specific detection of mutant HIV-1 at codon 62 of the reverse transcriptase gene.
cartatttgyataaaraa

SEQ ID NO: 6651 - DNA, 17 bp, Artificial Sequence
  Oligonucleotide probe
  misc_binding (1)..(17): Hybridization probe for the specific detection of mutant HIV-1 at codon 62 of the reverse transcriptase gene.
artatttgyataaaraa

SEQ ID NO: 6652 - DNA, 15 bp, Artificial Sequence
  Oligonucleotide probe
  misc_binding (1)..(15): Hybridization probe for the specific detection of mutant HIV-1 at codon 62 of the reverse transcriptase gene.
artatttgyataaar

SEQ ID NO: 6653 - DNA, 13 bp, Artificial Sequence
  Oligonucleotide probe
  misc_binding (1)..(13): Hybridization probe for the specific detection of mutant HIV-1 at codon 62 of the reverse transcriptase gene.
artatttgyataa

SEQ ID NO: 6654 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (18)..(18): base is a locked nucleic acid
cyataaararaargayag

SEQ ID NO: 6655 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (13)..(13): base is a locked nucleic acid
yataaaraaaargayagy

SEQ ID NO: 6656 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (16)..(16): base is a locked nucleic acid
cyataaararaargayag

SEQ ID NO: 6657 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (10)..(10): base is a locked nucleic acid
yataaaraaaargayagy

SEQ ID NO: 6658 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (17)..(17): base is a locked nucleic acid
cyataaararaargayag

SEQ ID NO: 6659 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (16)..(16): base is a locked nucleic acid
yataaaraaaargayagy

SEQ ID NO: 6660 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (12)..(12): base is a locked nucleic acid
cyataaararaargayag

SEQ ID NO: 6661 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (14)..(14): base is a locked nucleic acid
yataaaraaaargayagy

SEQ ID NO: 6662 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (7)..(7): base is a locked nucleic acid
cyataaararaargayag

SEQ ID NO: 6663 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (3)..(3): base is a locked nucleic acid
yataaaraaaargayagy

SEQ ID NO: 6664 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (3)..(3): base is a locked nucleic acid
cyataaararaargayag

SEQ ID NO: 6665 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (7)..(7): base is a locked nucleic acid
yataaaraaaargayagy

SEQ ID NO: 6666 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (2)..(2): base is a locked nucleic acid
cyataaararaargayag

SEQ ID NO: 6667 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (2)..(2): base is a locked nucleic acid
yataaaraaaargayagy

SEQ ID NO: 6668 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (4)..(4): base is a locked nucleic acid
cyataaararaargayag

SEQ ID NO: 6669 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (8)..(8): base is a locked nucleic acid
yataaaraaaargayagy

SEQ ID NO: 6670 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (12)..(12): base is a locked nucleic acid
cyataaararaargayag

SEQ ID NO: 6671 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (16)..(16): base is a locked nucleic acid
yataaaraaaargayagy

SEQ ID NO: 6672 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (15)..(15): base is a locked nucleic acid
cyataaararaargayag

SEQ ID NO: 6673 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (15)..(15): base is a locked nucleic acid
yataaaraaaargayagy

SEQ ID NO: 6674 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (13)..(13): base is a locked nucleic acid
cyataaararaargayag

SEQ ID NO: 6675 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (12)..(12): base is a locked nucleic acid
yataaaraaaargayagy

SEQ ID NO: 6676 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (14)..(14): base is a locked nucleic acid
cyataaararaargayag

SEQ ID NO: 6677 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
  modified_base (13)..(13): base is a locked nucleic acid
yataaaraaaargayagy

SEQ ID NO: 6678 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (4)..(4): base is a locked nucleic acid
  modified_base (9)..(9): base is a locked nucleic acid
  modified_base (10)..(10): base is a locked nucleic acid
cyataaararaargayag

SEQ ID NO: 6679 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (4)..(4): base is a locked nucleic acid
  modified_base (9)..(9): base is a locked nucleic acid
  modified_base (10)..(10): base is a locked nucleic acid
yataaaraaaargayagy

SEQ ID NO: 6680 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (7)..(7): base is a locked nucleic acid
  modified_base (9)..(9): base is a locked nucleic acid
  modified_base (10)..(10): base is a locked nucleic acid
cyataaararaargayag

SEQ ID NO: 6681 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (10)..(10): base is a locked nucleic acid
yataaaraaaargayagy

SEQ ID NO: 6682 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (2)..(2): base is a locked nucleic acid
  modified_base (9)..(9): base is a locked nucleic acid
  modified_base (10)..(10): base is a locked nucleic acid
cyataaararaargayag

SEQ ID NO: 6683 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (3)..(3): base is a locked nucleic acid
  modified_base (9)..(9): base is a locked nucleic acid
  modified_base (10)..(10): base is a locked nucleic acid
yataaaraaaargayagy

SEQ ID NO: 6684 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (3)..(3): base is a locked nucleic acid
  modified_base (9)..(9): base is a locked nucleic acid
  modified_base (10)..(10): base is a locked nucleic acid
cyataaararaargayag

SEQ ID NO: 6685 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (5)..(5): base is a locked nucleic acid
  modified_base (9)..(9): base is a locked nucleic acid
  modified_base (10)..(10): base is a locked nucleic acid
yataaaraaaargayagy

SEQ ID NO: 6686 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
cyataaararaargayag

SEQ ID NO: 6687 - DNA, 18 bp, Artificial Sequence
  Oligonucleotide probe
  misc_binding (1)..(18): Hybridization probe for the specific detection of mutant HIV-1 at codon 65 of the reverse transcriptase gene.
  modified_base (9)..(9): base is a locked nucleic acid
  modified_base (10)..(10): base is a locked nucleic acid
yataaaraaaargayagy

SEQ ID NO: 6688 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (17)..(17): base is a locked nucleic acid
yataaararaargayag

SEQ ID NO: 6689 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (12)..(12): base is a locked nucleic acid
ataaaraaaargayagy

SEQ ID NO: 6690 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (15)..(15): base is a locked nucleic acid
yataaararaargayag

SEQ ID NO: 6691 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (9)..(9): base is a locked nucleic acid
ataaaraaaargayagy

SEQ ID NO: 6692 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (16)..(16): base is a locked nucleic acid
yataaararaargayag

SEQ ID NO: 6693 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (15)..(15): base is a locked nucleic acid
ataaaraaaargayagy

SEQ ID NO: 6694 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (11)..(11): base is a locked nucleic acid
yataaararaargayag

SEQ ID NO: 6695 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (13)..(13): base is a locked nucleic acid
ataaaraaaargayagy

SEQ ID NO: 6696 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (6)..(6): base is a locked nucleic acid
yataaararaargayag

SEQ ID NO: 6697 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (2)..(2): base is a locked nucleic acid
ataaaraaaargayagy

SEQ ID NO: 6698 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (2)..(2): base is a locked nucleic acid
yataaararaargayag

SEQ ID NO: 6699 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (6)..(6): base is a locked nucleic acid
ataaaraaaargayagy

SEQ ID NO: 6700 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (1)..(1): base is a locked nucleic acid
yataaararaargayag

SEQ ID NO: 6701 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (1)..(1): base is a locked nucleic acid
ataaaraaaargayagy

SEQ ID NO: 6702 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (3)..(3): base is a locked nucleic acid
yataaararaargayag

SEQ ID NO: 6703 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (7)..(7): base is a locked nucleic acid
ataaaraaaargayagy

SEQ ID NO: 6704 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (11)..(11): base is a locked nucleic acid
yataaararaargayag

SEQ ID NO: 6705 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (15)..(15): base is a locked nucleic acid
ataaaraaaargayagy

SEQ ID NO: 6706 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (14)..(14): base is a locked nucleic acid
yataaararaargayag

SEQ ID NO: 6707 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (14)..(14): base is a locked nucleic acid
ataaaraaaargayagy

SEQ ID NO: 6708 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (12)..(12): base is a locked nucleic acid
yataaararaargayag

SEQ ID NO: 6709 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (11)..(11): base is a locked nucleic acid
ataaaraaaargayagy

SEQ ID NO: 6710 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (13)..(13): base is a locked nucleic acid
yataaararaargayag

SEQ ID NO: 6711 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (12)..(12): base is a locked nucleic acid
ataaaraaaargayagy

SEQ ID NO: 6712 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (3)..(3): base is a locked nucleic acid
  modified_base (8)..(8): base is a locked nucleic acid
  modified_base (9)..(9): base is a locked nucleic acid
yataaararaargayag

SEQ ID NO: 6713 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (3)..(3): base is a locked nucleic acid
  modified_base (8)..(8): base is a locked nucleic acid
  modified_base (9)..(9): base is a locked nucleic acid
ataaaraaaargayagy

SEQ ID NO: 6714 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (6)..(6): base is a locked nucleic acid
  modified_base (8)..(8): base is a locked nucleic acid
  modified_base (9)..(9): base is a locked nucleic acid
yataaararaargayag

SEQ ID NO: 6715 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (7)..(7): base is a locked nucleic acid
  modified_base (8)..(8): base is a locked nucleic acid
  modified_base (9)..(9): base is a locked nucleic acid
ataaaraaaargayagy

SEQ ID NO: 6716 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (1)..(1): base is a locked nucleic acid
  modified_base (8)..(8): base is a locked nucleic acid
  modified_base (9)..(9): base is a locked nucleic acid
yataaararaargayag

SEQ ID NO: 6717 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (2)..(2): base is a locked nucleic acid
  modified_base (8)..(8): base is a locked nucleic acid
  modified_base (9)..(9): base is a locked nucleic acid
ataaaraaaargayagy

SEQ ID NO: 6718 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (2)..(2): base is a locked nucleic acid
  modified_base (8)..(8): base is a locked nucleic acid
  modified_base (9)..(9): base is a locked nucleic acid
yataaararaargayag

SEQ ID NO: 6719 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (4)..(4): base is a locked nucleic acid
  modified_base (8)..(8): base is a locked nucleic acid
  modified_base (9)..(9): base is a locked nucleic acid
ataaaraaaargayagy

SEQ ID NO: 6720 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
yataaararaargayag

SEQ ID NO: 6721 - DNA, 17 bp, Artificial Sequence
  Oligonucleotide probe
  misc_binding (1)..(17): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
ataaaraaaargayagy

SEQ ID NO: 6722 - DNA, 16 bp, Artificial Sequence
  Oligonucleotide probe
  misc_binding (1)..(16): Hybridization probe for the specific detection of mutant HIV-1 at codon 65 of the reverse transcriptase gene.
yataaararaargaya

SEQ ID NO: 6723 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (12)..(12): base is a locked nucleic acid
ataaaraaaargaya

SEQ ID NO: 6724 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (15)..(15): base is a locked nucleic acid
yataaararaargay

SEQ ID NO: 6725 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (9)..(9): base is a locked nucleic acid
ataaaraaaargaya

SEQ ID NO: 6726 - DNA, 15 bp, Artificial Sequence
  Oligonucleotide probe
  misc_binding (1)..(15): Hybridization probe for the specific detection of mutant HIV-1 at codon 65 of the reverse transcriptase gene.
yataaararaargay

SEQ ID NO: 6727 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (15)..(15): base is a locked nucleic acid
ataaaraaaargaya

SEQ ID NO: 6728 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (11)..(11): base is a locked nucleic acid
yataaararaargay

SEQ ID NO: 6729 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (13)..(13): base is a locked nucleic acid
ataaaraaaargaya

SEQ ID NO: 6730 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (6)..(6): base is a locked nucleic acid
yataaararaargay

SEQ ID NO: 6731 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (2)..(2): base is a locked nucleic acid
ataaaraaaargaya

SEQ ID NO: 6732 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (2)..(2): base is a locked nucleic acid
yataaararaargay

SEQ ID NO: 6733 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (6)..(6): base is a locked nucleic acid
ataaaraaaargaya

SEQ ID NO: 6734 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (1)..(1): base is a locked nucleic acid
yataaararaargay

SEQ ID NO: 6735 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (1)..(1): base is a locked nucleic acid
ataaaraaaargaya

SEQ ID NO: 6736 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (3)..(3): base is a locked nucleic acid
yataaararaargay

SEQ ID NO: 6737 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (7)..(7): base is a locked nucleic acid
ataaaraaaargaya

SEQ ID NO: 6738 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (11)..(11): base is a locked nucleic acid
yataaararaargay

SEQ ID NO: 6739 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (15)..(15): base is a locked nucleic acid
ataaaraaaargaya

SEQ ID NO: 6740 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (14)..(14): base is a locked nucleic acid
yataaararaargay

SEQ ID NO: 6741 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (14)..(14): base is a locked nucleic acid
ataaaraaaargaya

SEQ ID NO: 6742 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (12)..(12): base is a locked nucleic acid
yataaararaargay

SEQ ID NO: 6743 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (11)..(11): base is a locked nucleic acid
ataaaraaaargaya

SEQ ID NO: 6744 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (13)..(13): base is a locked nucleic acid
yataaararaargay

SEQ ID NO: 6745 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (12)..(12): base is a locked nucleic acid
ataaaraaaargaya

SEQ ID NO: 6746 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (3)..(3): base is a locked nucleic acid
  modified_base (8)..(8): base is a locked nucleic acid
  modified_base (9)..(9): base is a locked nucleic acid
yataaararaargay

SEQ ID NO: 6747 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (3)..(3): base is a locked nucleic acid
  modified_base (8)..(8): base is a locked nucleic acid
  modified_base (9)..(9): base is a locked nucleic acid
ataaaraaaargaya

SEQ ID NO: 6748 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (6)..(6): base is a locked nucleic acid
  modified_base (8)..(8): base is a locked nucleic acid
  modified_base (9)..(9): base is a locked nucleic acid
yataaararaargay

SEQ ID NO: 6749 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (7)..(7): base is a locked nucleic acid
  modified_base (8)..(8): base is a locked nucleic acid
  modified_base (9)..(9): base is a locked nucleic acid
ataaaraaaargaya

SEQ ID NO: 6750 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (1)..(1): base is a locked nucleic acid
  modified_base (8)..(8): base is a locked nucleic acid
  modified_base (9)..(9): base is a locked nucleic acid
yataaararaargay

SEQ ID NO: 6751 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (2)..(2): base is a locked nucleic acid
  modified_base (8)..(8): base is a locked nucleic acid
  modified_base (9)..(9): base is a locked nucleic acid
ataaaraaaargaya

SEQ ID NO: 6752 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (2)..(2): base is a locked nucleic acid
  modified_base (8)..(8): base is a locked nucleic acid
  modified_base (9)..(9): base is a locked nucleic acid
yataaararaargay

SEQ ID NO: 6753 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (4)..(4): base is a locked nucleic acid
  modified_base (8)..(8): base is a locked nucleic acid
  modified_base (9)..(9): base is a locked nucleic acid
ataaaraaaargaya

SEQ ID NO: 6754 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
yataaararaargay

SEQ ID NO: 6755 - DNA, 15 bp, Artificial Sequence
  Oligonucleotide probe
  misc_binding (1)..(15): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
ataaaraaaargaya

SEQ ID NO: 6756 - DNA, 14 bp, Artificial Sequence
  Oligonucleotide probe
  misc_binding (1)..(14): Hybridization probe for the specific detection of mutant HIV-1 at codon 65 of the reverse transcriptase gene.
yataaararaarga

SEQ ID NO: 6757 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (12)..(12): base is a locked nucleic acid
ataaaraaaarga

SEQ ID NO: 6758 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (9)..(9): base is a locked nucleic acid
ataaaraaaarga

SEQ ID NO: 6759 - DNA, 14 bp, Artificial Sequence
  Oligonucleotide probe
  misc_binding (1)..(14): Hybridization probe for the specific detection of mutant HIV-1 at codon 65 of the reverse transcriptase gene.
ataaaraaaargay

SEQ ID NO: 6760 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (11)..(11): base is a locked nucleic acid
yataaararaarg

SEQ ID NO: 6761 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (13)..(13): base is a locked nucleic acid
ataaaraaaarga

SEQ ID NO: 6762 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (6)..(6): base is a locked nucleic acid
yataaararaarg

SEQ ID NO: 6763 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (2)..(2): base is a locked nucleic acid
ataaaraaaarga

SEQ ID NO: 6764 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (2)..(2): base is a locked nucleic acid
yataaararaarg

SEQ ID NO: 6765 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (6)..(6): base is a locked nucleic acid
ataaaraaaarga

SEQ ID NO: 6766 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (1)..(1): base is a locked nucleic acid
yataaararaarg

SEQ ID NO: 6767 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (1)..(1): base is a locked nucleic acid
ataaaraaaarga

SEQ ID NO: 6768 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (3)..(3): base is a locked nucleic acid
yataaararaarg

SEQ ID NO: 6769 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (7)..(7): base is a locked nucleic acid
ataaaraaaarga

SEQ ID NO: 6770 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (11)..(11): base is a locked nucleic acid
yataaararaarg

SEQ ID NO: 6771 - DNA, 14 bp, Artificial Sequence
  Oligonucleotide probe
  misc_binding (1)..(14): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
ataaaraaaargay

SEQ ID NO: 6772 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
yataaararaarg

SEQ ID NO: 6773 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
ataaaraaaarga

SEQ ID NO: 6774 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (12)..(12): base is a locked nucleic acid
yataaararaarg

SEQ ID NO: 6775 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (11)..(11): base is a locked nucleic acid
ataaaraaaarga

SEQ ID NO: 6776 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (13)..(13): base is a locked nucleic acid
yataaararaarg

SEQ ID NO: 6777 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
  modified_base (12)..(12): base is a locked nucleic acid
ataaaraaaarga

SEQ ID NO: 6778 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (3)..(3): base is a locked nucleic acid
  modified_base (8)..(8): base is a locked nucleic acid
  modified_base (9)..(9): base is a locked nucleic acid
yataaararaarg

SEQ ID NO: 6779 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (3)..(3): base is a locked nucleic acid
  modified_base (8)..(8): base is a locked nucleic acid
  modified_base (9)..(9): base is a locked nucleic acid
ataaaraaaarga

SEQ ID NO: 6780 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (6)..(6): base is a locked nucleic acid
  modified_base (8)..(8): base is a locked nucleic acid
  modified_base (9)..(9): base is a locked nucleic acid
yataaararaarg

SEQ ID NO: 6781 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (7)..(7): base is a locked nucleic acid
  modified_base (8)..(8): base is a locked nucleic acid
  modified_base (9)..(9): base is a locked nucleic acid
ataaaraaaarga

SEQ ID NO: 6782 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (1)..(1): base is a locked nucleic acid
  modified_base (8)..(8): base is a locked nucleic acid
  modified_base (9)..(9): base is a locked nucleic acid
yataaararaarg

SEQ ID NO: 6783 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (2)..(2): base is a locked nucleic acid
  modified_base (8)..(8): base is a locked nucleic acid
  modified_base (9)..(9): base is a locked nucleic acid
ataaaraaaarga

SEQ ID NO: 6784 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (2)..(2): base is a locked nucleic acid
  modified_base (8)..(8): base is a locked nucleic acid
  modified_base (9)..(9): base is a locked nucleic acid
yataaararaarg

SEQ ID NO: 6785 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (4)..(4): base is a locked nucleic acid
  modified_base (8)..(8): base is a locked nucleic acid
  modified_base (9)..(9): base is a locked nucleic acid
ataaaraaaarga

SEQ ID NO: 6786 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
yataaararaarg

SEQ ID NO: 6787 - DNA, 13 bp, Artificial Sequence
  Oligonucleotide probe
  misc_binding (1)..(13): Hybridization probe for the specific detection of mutant HIV-1 at codon 65 of the reverse transcriptase gene.
  modified_base (8)..(8): base is a locked nucleic acid
  modified_base (9)..(9): base is a locked nucleic acid
ataaaraaaarga

SEQ ID NO: 6788 - DNA, 15 bp, Artificial Sequence
  Oligonucleotide probe
  misc_binding (1)..(15): Hybridization probe for the specific detection of mutant HIV-1 at codon 65 of the reverse transcriptase gene.
ataaagmgraaagac

SEQ ID NO: 6789 - DNA, 15 bp, Artificial Sequence
  Oligonucleotide probe
  misc_binding (1)..(15): Hybridization probe for the specific detection of mutant HIV-1 at codon 65 of the reverse transcriptase gene.
ataaagaayaaagac

SEQ ID NO: 6790 - DNA, 18 bp, Artificial Sequence
  Oligonucleotide probe
  misc_binding (1)..(18): Hybridization probe for the specific detection of mutant HIV-1 at codon 65 of the reverse transcriptase gene.
cyataaararaargayag

SEQ ID NO: 6791 - DNA, 18 bp, Artificial Sequence
  Oligonucleotide probe
  misc_binding (1)..(18): Hybridization probe for the specific detection of mutant HIV-1 at codon 65 of the reverse transcriptase gene.
yataaaraaaargayagy

SEQ ID NO: 6792 - DNA, 17 bp, Artificial Sequence
  Oligonucleotide probe
  misc_binding (1)..(17): Hybridization probe for the specific detection of mutant HIV-1 at codon 65 of the reverse transcriptase gene.
yataaararaargayag

SEQ ID NO: 6793 - DNA, 17 bp, Artificial Sequence
  Oligonucleotide probe
  misc_binding (1)..(17): Hybridization probe for the specific detection of mutant HIV-1 at codon 65 of the reverse transcriptase gene.
ataaaraaaargayagy

SEQ ID NO: 6794 - DNA, 15 bp, Artificial Sequence
  Oligonucleotide probe
  misc_binding (1)..(15): Hybridization probe for the specific detection of mutant HIV-1 at codon 65 of the reverse transcriptase gene.
ataaaraaaargaya

SEQ ID NO: 6795 - DNA, 15 bp, Artificial Sequence
  Oligonucleotide probe
  misc_binding (1)..(15): Hybridization probe for the specific detection of mutant HIV-1 at codon 65 of the reverse transcriptase gene.
yataaararaargay

SEQ ID NO: 6796 - DNA, 13 bp, Artificial Sequence
  Oligonucleotide probe
  misc_binding (1)..(13): Hybridization probe for the specific detection of mutant HIV-1 at codon 65 of the reverse transcriptase gene.
ataaaraaaarga

SEQ ID NO: 6797 - DNA, 13 bp, Artificial Sequence
  Oligonucleotide probe
  misc_binding (1)..(13): Hybridization probe for the specific detection of mutant HIV-1 at codon 65 of the reverse transcriptase gene.
yataaararaarg

SEQ ID NO: 6798 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (11)..(11): base is a locked nucleic acid
aaraaraarayagyacya

SEQ ID NO: 6799 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (13)..(13): base is a locked nucleic acid
araaraargyagyacyaa

SEQ ID NO: 6800 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (18)..(18): base is a locked nucleic acid
raaraargaagyacyaar

SEQ ID NO: 6801 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (16)..(16): base is a locked nucleic acid
aaraaraarayagyacya

SEQ ID NO: 6802 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (11)..(11): base is a locked nucleic acid
araaraargyagyacyaa

SEQ ID NO: 6803 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (16)..(16): base is a locked nucleic acid
raaraargaagyacyaar

SEQ ID NO: 6804 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (13)..(13): base is a locked nucleic acid
aaraaraarayagyacya

SEQ ID NO: 6805 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (17)..(17): base is a locked nucleic acid
araaraargyagyacyaa

SEQ ID NO: 6806 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (17)..(17): base is a locked nucleic acid
raaraargaagyacyaar

SEQ ID NO: 6807 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (10)..(10): base is a locked nucleic acid
aaraaraarayagyacya

SEQ ID NO: 6808 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (16)..(16): base is a locked nucleic acid
araaraargyagyacyaa

SEQ ID NO: 6809 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (12)..(12): base is a locked nucleic acid
raaraargaagyacyaar

SEQ ID NO: 6810 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (4)..(4): base is a locked nucleic acid
aaraaraarayagyacya

SEQ ID NO: 6811 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (3)..(3): base is a locked nucleic acid
araaraargyagyacyaa

SEQ ID NO: 6812 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (7)..(7): base is a locked nucleic acid
raaraargaagyacyaar

SEQ ID NO: 6813 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (8)..(8): base is a locked nucleic acid
aaraaraarayagyacya

SEQ ID NO: 6814 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (7)..(7): base is a locked nucleic acid
araaraargyagyacyaa

SEQ ID NO: 6815 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (3)..(3): base is a locked nucleic acid
raaraargaagyacyaar

SEQ ID NO: 6816 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (3)..(3): base is a locked nucleic acid
aaraaraarayagyacya

SEQ ID NO: 6817 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (8)..(8): base is a locked nucleic acid
araaraargyagyacyaa

SEQ ID NO: 6818 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (2)..(2): base is a locked nucleic acid
raaraargaagyacyaar

SEQ ID NO: 6819 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (7)..(7): base is a locked nucleic acid
aaraaraarayagyacya

SEQ ID NO: 6820 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (6)..(6): base is a locked nucleic acid
araaraargyagyacyaa

SEQ ID NO: 6821 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (4)..(4): base is a locked nucleic acid
raaraargaagyacyaar

SEQ ID NO: 6822 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (11)..(11): base is a locked nucleic acid
aaraaraarayagyacya

SEQ ID NO: 6823 - DNA, 18 bp, Artificial Sequence
  Oligonucleotide probe
  misc_binding (1)..(18): Hybridization probe for the specific detection of mutant HIV-1 at codon 67 of the reverse transcriptase gene.
  modified_base (9)..(9): base is a locked nucleic acid
  modified_base (10)..(10): base is a locked nucleic acid
  modified_base (14)..(14): base is a locked nucleic acid
araaraargyagyacyaa

(The sequence listing continues in the following parts.)

What is claimed is:

1. A method of determining the presence of a polymorphism at one or more of a target nucleotide position in a plurality of target nucleic acid sequences, with each target nucleic acid sequence having a sense strand sequence and an antisense strand sequence, wherein the one or more of a target nucleotide position is flanked by a 5' flanking region and a 3' flanking region in each of the sense strand sequence and the antisense strand sequence comprising amplifying the target nucleic acid sequences to produce amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the amplicons have a sense strand amplicon and an antisense strand amplicon, wherein the sense strand amplicon includes a probe binding site including one or more of a target nucleotide at the one or more of a target nucleotide position with a 5' flanking region being the 3' adapter region sequence of the forward primer and with a 3' flanking region being the complement of the 3' adapter region sequence of the reverse primer, wherein the antisense strand amplicon includes a probe binding site including one or more of a target nucleotide at the one or more of a target nucleotide position with a 5' flanking region being the 3' adapter region sequence of the reverse primer and with a 3' flanking region being the complement of the 3' adaptor region of the forward primer, contacting the amplicons with sense-oriented nucleic acid probes or antisense-oriented nucleic acid probes including a label and having a probe sequence identical to the complement of the probe binding site, and detecting the label of hybridized nucleic acid probes.

2. The method of claim 1, wherein the forward primer further includes a pan degenerate region.

3. The method of claim 1 wherein the reverse primer further includes a pan degenerate region.

4. The method of claim 1 wherein the plurality of target nucleotide sequences is a population of viral nucleic acids, bacterial nucleic acids, or fungal nucleic acids.

5. The method of claim 4 wherein the viral nucleic acids are viral RNA or viral DNA.

6. The method of claim 4 wherein the bacterial nucleic acids are bacterial RNA or bacterial DNA.

7. The method of claim 4 wherein the fungal nucleic acids are fungal RNA or fungal DNA.

8. The method of claim 1 wherein the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position.

9. The method of claim 1 wherein the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, wherein the polymorphism provides drug resistance.

10. The method of claim 1 wherein the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable.

11. The method of claim 1 wherein the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable, wherein the method further includes determining the relative amount of the wild type viral nucleic acids versus the mutated viral nucleic acids by comparing the detected labels.

12. The method of claim 1 wherein the plurality of target nucleotide sequences is a population of viral nucleic acids including wild type viral nucleic acids with a wild type nucleotide at the one or more of a target nucleotide position and mutated viral nucleic acids with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable, wherein the method further includes determining the relative amount of the wild type viral nucleic acids versus the mutated viral nucleic acids by comparing the detected labels, wherein the relative amount is indicative of drug resistance of the population of viral nucleic acids.

13. The method of claim 1 wherein the plurality of target nucleotide sequences is a population of viral nucleic acids including wild type viral nucleic acids with a wild type nucleotide at the one or more of a target nucleotide position and mutated viral nucleic acid with the polymorphism at the one or more of a target nucleotide position, and wherein the sense oriented nucleic acid probes or the antisense oriented nucleic acid probes include wild type probes with a first label and mutant detecting probes with a second label and where the first label and the second label are spectrally resolvable, wherein the method further includes determining the relative amount of the wild type viral nucleic acids versus the mutated viral nucleic acids by comparing the detected labels, wherein the relative amount is indicative of the presence of virulent versus non-virulent strains of virus.

14. The method of claim 1 wherein the plurality of target nucleotide sequences is a population of viral nucleic acids with first viral nucleic acids having a first nucleotide at the one or more of a target nucleotide position indicative of a non-virulent strain of virus and mutated viral nucleic acids with the polymorphism at the one or more of a target nucleotide position indicative of a virulent strain of virus, and wherein the sense oriented nucleic acid probes or the antisense oriented nucleic acid probes include mutant detecting probes with a first label and wherein detecting the first label is indicative of the presence of the virulent strain of virus.

15. The method of claim 1 wherein the forward primers and the reverse primers have constant adaptor regions and variable pan degenerate regions.

16. The method of claim 1 wherein the nucleic acid probes include molecular beacons, hydrolysis probes, locked nucleic acid probes, or FRET probes.

17. The method of claim 1 wherein the plurality of target nucleotide sequences comprises a population of HIV viral DNA, Newcastle disease viral DNA, or hepatitis C viral DNA.

18. The method of claim 1 wherein the polymorphism at the one or more of a target nucleotide position is a single nucleotide polymorphism.

19. The method of claim 1 wherein the 5' flanking region to the one or more of a target nucleotide position is between about 1 to about 10 nucleotides in length and wherein the 3' flanking region to the one or more of a target nucleotide position is between about 1 to about 10 nucleotides in length.

20. The method of claim 1 wherein the 5' flanking region to the one or more of a target nucleotide position is between about 3 to about 8 nucleotides in length and wherein the 3' flanking region to the one or more of a target nucleotide position is between about 3 to about 8 nucleotides in length.

21. The method of claim 1 wherein the 5' flanking region to the one or more of a target nucleotide position is between about 6 to about 8 nucleotides in length and wherein the 3' flanking region to the one or more of a target nucleotide position is between about 6 to about 8 nucleotides in length.

22. The method of claim 1 wherein the 5' flanking region to the one or more of a target nucleotide position is about 7 nucleotides in length and wherein the 3' flanking region to the one or more of a target nucleotide position is about 7 nucleotides in length.

23. The method of claim 1 wherein the sense oriented nucleic acid probe or the antisense oriented nucleic acid probe includes a complement to the nucleotide at the one or more of a target nucleotide position which is flanked by a 5' flanking region and a 3' flanking region.

24. The method of claim 1 wherein the sense oriented nucleic acid probe or the antisense oriented nucleic acid probe is an exact complement of the probe binding site of the amplicons.

25. The method of claim 1 wherein the sense oriented nucleic acid probe or the antisense oriented nucleic acid probe is about 10 to about 20 nucleotides in length.

26. The method of claim 1 wherein the sense oriented nucleic acid probe or the antisense oriented nucleic acid probe is about 12 to about 15 nucleotides in length.

27. The method of claim 1 wherein the sense oriented nucleic acid probe or the antisense oriented nucleic acid probe is about 15 nucleotides in length.

28. The method of claim 2 wherein the pan degenerate region is between about 25 to about 35 nucleotides in length.

29. The method of claim 2 wherein the pan degenerate region is between about 28 to about 32 nucleotides in length.

30. The method of claim 2 wherein the pan degenerate region is about 30 nucleotides in length.

31. The method of claim 1 wherein the label is a fluorescent label.

32. A method of mutating flanking regions of one or more of a target nucleotide position in a plurality of target nucleic acid sequences to provide a known probe binding site on amplicons, with each target nucleic acid sequence having a sense strand sequence and an antisense strand sequence, wherein the one or more of a target nucleotide position is flanked by a 5' flanking region and a 3' flanking region in each of the sense strand sequence and the antisense strand sequence comprising
   amplifying the target nucleic acid sequence to produce the amplicons using a forward primer and a reverse primer, wherein the forward primer includes a 3' adaptor region, wherein the 3' adaptor region is a determined consensus sequence for the 5' flanking region of the sense strand,
   wherein the reverse primer includes a 3' adaptor region, wherein the 3' adaptor region is complementary to a determined consensus sequence for the 3' flanking region of the sense strand,
   wherein the amplicons have the known probe binding site determined by the determined consensus sequences from the forward and reverse primers and the target nucleotide at the one or more of a target nucleotide position.

33. The method of claim 32 wherein a polymorphism is present at the one or more of a target nucleotide position.

34. The method of claim 32 wherein a single nucleotide polymorphism is present at the one or more of a target nucleotide position.

35. A method of providing a known probe binding site sequence including one or more of a target nucleotide in amplicons of a plurality of target nucleic acid sequences, with each target nucleic acid sequence having a sense strand sequence and an antisense strand sequence, wherein one or more of a target nucleotide position is flanked by a 5' flanking region and a 3' flanking region in each of the sense strand sequence and the antisense strand sequence comprising amplifying the target nucleic acid sequence to produce the amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the known probe binding site of the amplicons is determined by the determined consensus sequences from the forward and reverse primers and the target nucleotide at the one or more of a target nucleotide position.

36. The method of claim 35, wherein the forward primer further includes a pan degenerate region.

37. The method of claim 35 wherein the reverse primer further includes a pan degenerate region.

38. The method of claim 35 wherein the one or more of a target nucleotide is a polymorphism.

39. The method of claim 35 wherein the one or more of a target nucleotide is a single nucleotide polymorphism.

40. A method of removing secondary polymorphisms flanking one or more of a target nucleotide position in a plurality of target nucleic acid sequences to provide a known probe binding site in amplicons, with each target nucleic acid sequence having a sense strand sequence and an antisense strand sequence, wherein the target nucleotide position is flanked by a 5' flanking region and a 3' flanking region in each of the sense strand sequence and the antisense strand sequence comprising amplifying the target nucleic acid sequence to produce the amplicons using a forward primer and a reverse primer, wherein the forward primer includes a 3' adaptor region, wherein the 3' adaptor region is a determined consensus sequence for the 5' flanking region of the sense strand, wherein the reverse primer includes a 3' adaptor region, wherein the 3' adaptor region is complementary to a determined consensus sequence for the 3' flanking region of the sense strand, wherein the amplicons have the known probe binding site determined by the determined consensus sequences from the forward and reverse primers and the target nucleotide at the one or more of a target nucleotide position.

41. The method of claim 40, wherein the forward primer further includes a pan degenerate region.

42. The method of claim 40 wherein the reverse primer further includes a pan degenerate region.

43. The method of claim 40 wherein a polymorphism is present at the one or more of a target nucleotide position.

44. The method of claim 40 wherein a single nucleotide polymorphism is present at the one or more of a target nucleotide position.

45. The method of claim 3 wherein the pan degenerate region is between about 25 to about 35 nucleotides in length.

46. The method of claim 3 wherein the pan degenerate region is between about 28 to about 32 nucleotides in length.

47. The method of claim 3 wherein the pan degenerate region is about 30 nucleotides in length.

\* \* \* \* \*